(12) United States Patent
Distler et al.

(10) Patent No.: US 7,951,563 B2
(45) Date of Patent: May 31, 2011

(54) METHODS AND NUCLEIC ACIDS FOR ANALYSIS OF CELLULAR PROLIFERATIVE DISORDERS

(75) Inventors: Juergen Distler, Berlin (DE); Thomas Hildmann, Berlin (DE); Ralf Lesche, Berlin (DE); Catherine Lofton-Day, Seattle, WA (US); Fabian Model, Berlin (DE); Matthias Schuster, Berlin (DE); Andrew Z. Sledziewski, Shoreline, WA (US); Reimo Tetzner, Berlin (DE); Xiaoling Song, Woodinville, WA (US)

(73) Assignee: Epigenomics AG, Berlin (DE)

( * ) Notice: Subject to any disclaimer, the term of this patent is extended or adjusted under 35 U.S.C. 154(b) by 532 days.

(21) Appl. No.: 11/911,617

(22) PCT Filed: Apr. 17, 2006

(86) PCT No.: PCT/US2006/014131
§ 371 (c)(1),
(2), (4) Date: Dec. 6, 2007

(87) PCT Pub. No.: WO2006/113466
PCT Pub. Date: Oct. 26, 2006

(65) Prior Publication Data
US 2009/0075260 A1    Mar. 19, 2009

Related U.S. Application Data

(60) Provisional application No. 60/672,242, filed on Apr. 15, 2005, provisional application No. 60/676,997, filed on May 2, 2005, provisional application No. 60/697,521, filed on Jul. 8, 2005, provisional application No. 60/704,860, filed on Aug. 1, 2005, provisional application No. 60/709,318, filed on Aug. 17, 2005, provisional application No. 60/723,602, filed on Oct. 4, 2005, provisional application No. 60/787,402, filed on Mar. 30, 2006.

(51) Int. Cl.
*C12P 19/34* (2006.01)
*C12Q 1/68* (2006.01)

(52) U.S. Cl. .......................... 435/91.2; 435/6
(58) Field of Classification Search .................. None
See application file for complete search history.

(56) References Cited

U.S. PATENT DOCUMENTS

| | | | |
|---|---|---|---|
| 5,565,552 A | 10/1996 | Magda et al. |
| 5,567,810 A | 10/1996 | Weis et al. |
| 5,574,142 A | 11/1996 | Meyer, Jr. et al. |
| 5,585,481 A | 12/1996 | Arnold, Jr. et al. |
| 5,587,371 A | 12/1996 | Sessler et al. |
| 5,597,696 A | 1/1997 | Linn et al. |
| 5,786,146 A | 7/1998 | Herman et al. |
| 5,958,773 A | 9/1999 | Monia et al. |
| 6,251,594 B1 | 6/2001 | Gonzalgo et al. |
| 6,265,171 B1 | 7/2001 | Herman et al. |
| 6,331,393 B1 | 12/2001 | Laird et al. |
| 6,783,933 B1 | 8/2004 | Issa |
| 7,112,404 B2 | 9/2006 | Laird |
| 2003/0013091 A1 | 1/2003 | Dimitrov |

FOREIGN PATENT DOCUMENTS

| | | |
|---|---|---|
| WO | WO 95/00669 | 1/1995 |
| WO | WO 95/15373 | 6/1995 |
| WO | WO 97/46705 | 12/1997 |
| WO | WO 99/28498 | 6/1999 |
| WO | WO 99/31233 | 6/1999 |
| WO | WO 00/26401 | 5/2000 |
| WO | WO 03/042661 | 5/2003 |
| WO | WO 04/000463 | 12/2003 |
| WO | WO 2004/074441 | 9/2004 |
| WO | WO 2005/001141 | 1/2005 |
| WO | WO 2005/038051 | 4/2005 |

OTHER PUBLICATIONS

Schuebel et al., PLoS Genetics, vol. 3, iss. 9, pp. e157; 1709-1723, Sep. 2007.*
U.S. Appl. No. 60/672,242, filed Apr. 15, 2005, Lofton-Day et al.
U.S. Appl. No. 60/676,997, filed May 2, 2005, Lofton-Day et al.
U.S. Appl. No. 60/697,521, filed Jul. 8, 2005, Lesche et al.
U.S. Appl. No. 60/704,860, filed Aug. 1, 2005, Lesche et al.
U.S. Appl. No. 60/709,318, filed Aug. 17, 2005, Lesche et al.
U.S. Appl. No. 60/723,602, filed Oct. 4, 2005, Lesche et al.
U.S. Appl. No. 60/787,402, filed Mar. 30, 2006, Lesche et al.
Belyavsky et al., "PCR-based cDNA library construction: general cDNA libraries at the level of a few cells," Nucleic Acids Research, 1989, pp. 2919-2932, vol. 17.
Beysen et al., "The Human FOXL2 Mutation Database," Human Mutation, 2004, pp. 189-193, vol. 24.
Bloemental et al., "Activated vitronectin as a target for anticancer therapy with human antibodies," Cancer Immunology, Immunotherapy, 2004, pp. 799-808, vol. 53.
Bowtell, "Options available—from start to finish—for obtaining expression data by microarray," Nature Genetics Supplement, Jan. 1999, pp. 25-32, vol. 21.
Burrows et al., "Altered expression of the septin gene, SEPT9, in ovarian neoplasia," Journal of Pathology, 2003, pp. 581-588, vol. 201.
Cocquet et al., "Evolution and expression of FOXL2," Journal of Medical Genetics, 2002, pp. 916-922, vol. 39.
Cosgaya et al., "The Neurotrophin Receptor p75$^{NTR}$ as a Positive Modulator of Myelination," Science, 2002, pp. 1245-1248, vol. 298.
Database EMBL, "*Homo sapiens* chromosome 17, clone RP11-936I5," Feb. 18, 2002, Database Accession No. EM_HUM:AC111182.

(Continued)

*Primary Examiner* — Gary Benzion
*Assistant Examiner* — Cynthia B Wilder
(74) *Attorney, Agent, or Firm* — DLA Piper LLP (US)

(57) ABSTRACT

Aspects of the invention provide methods, nucleic acids and kits for detecting, or for detecting and distinguishing between or among liver cell proliferative disorders or for detecting, or for detecting and distinguishing between or among colorectal cell proliferative disorders. Particular aspects disclose and provide genomic sequences the methylation patterns of which have substantial utility for the improved detection of and differentiation between said class of disorders, thereby enabling the improved diagnosis and treatment of patients.

8 Claims, 37 Drawing Sheets

OTHER PUBLICATIONS

De Baere et al., "FOXL2 and BPES: Mutational Hotspots, Phenotypic Variability, and Revision of the Genotype-Phenotype Correlation," American Journal of Human Genetics, 2003, pp. 478-487, vol. 72.

Dobrowsky et al., "Activation of the Sphingomyelin Cycle Through the Low-Affinity Neurotrophin Receptor," Science, 1994, pp. 1596-1599, vol. 265.

Eads et al., "CpG Island Hypermethylation in Human Colorectal Tumors Is Not Associated with DNA Methyltransferase Overexpression," Cancer Research, May 15, 1999, pp. 2302-2306, vol. 59.

Feil et al., "Methylation analysis on individual chromosomes: improved protocol for bisulphite genomic sequencing," Nucleic Acids Research, 1994, pp. 695-696, vol. 22.

Frommer et al., "A genomic sequencing protocol that yields a positive display of 5-methylcytosine residues in individual DNA strands," PNAS, Mar. 1992, pp. 1827-1831, vol. 89.

Galfre et al., "Preparation of Monoclonal Antibodies: Strategies and Procedures," Methods in Enzymology, 1981, pp. 3-46, vol. 73.

Gonzalgo et al., "Identification and Characterization of Differentially Methylated Regions of Genomic DNA by Methylation-sensitve Arbitrarily Primed PCR," Cancer Research, Feb. 15, 1997, pp. 594-599, vol. 57.

Gonzalgo et al., Rapid quantitation of methylation differences at specific sites using methylation-sensitive single nucleotide primer extension (Ms-SNuPE), Nucleic Acids Research, 1997, pp. 2529-2531, vol. 25, No. 12.

Grigg et al., "Sequencing 5-Methylcytosine Residues in Genomic DNA," BioEssays, Jun. 1994, pp. 431-436, vol. 16, No. 6.

Gut et al, "DNA and Matrix Assisted Laser Desorption Ionization Mass Spectrometry," Molecular Biology: Current Innovations and Future Trends, 1995, pp. 147-157, Horizon Scientific Press, Wymondham, United Kingdom.

Gut et al., "A procedure for selection DNA alkylation and detection by mass spectrometry," Nucleic Acids Research, 1995, pp. 1367-1373, vol. 23.

Haier et al., "Inhibition of tumor progression and neoangiogenesis using cyclic RGD-peptides in a chemically induced colon carcinoma in rats," Clinical & Experimental Metastasis, 2002, pp. 665-672, vol. 19.

Heid et al., "Real Time Quantitative PCR," Genome Research, 1996, pp. 986-994, vol. 6.

Herman et al., "Methylation-specific PCR: A novel PCR assay for methylation status of CpG islands," Sep. 1996, pp. 9821-9826, vol. 93.

Kalikin et al., "Genomic and Expression Analyses of Alternatively Spliced Transcripts of the MLL Septin-like Fusion Gene (MSF) That Map to a 17q25 Region of Loss in Breast and Ovarian Tumors," Genomics, 2000, pp. 165-172, vol. 63.

Karas et al., "Laser Desorption Ionization of Proteins with Molecular Masses Exceeding 10 000 Daltons," Analytical Chemistry, Oct. 15, 1988, pp. 2299-2301, vol. 60.

Koehler et al., "Continuous cultures of fused cells secreting antibody of predefined specificity," Nature, Aug. 7, 1975, pp. 495-496, vol. 256.

Krug et al., "First-Strand cDNA Synthesis Primed with Oligo(dT)," Methods in Enzymology, 1987, pp. 316-325, vol. 152.

Liang et al., "The Gene for a Novel Transmembrane Protein Containing Epidermal Growth Factor and Follistatin Domains Is Frequently Hypermethylated in Human Tumor Cells," Cancer Research, 2000, pp. 4907-4912, vol. 60.

Lipshutz et al., "High density synthetic oligonucleotide arrays," Nature Genetics Supplement, Jan. 1999, pp. 20-24, vol. 21.

Martin et al., "Genomic sequencing indicates a correlation between DNA hypomethylation in the 5' region of the pS2 gene and its expression in human breast cancer cell lines," Gene, 1995, pp. 261-264, vol. 157.

McIlhatton et al., "Genomic organization, complex splicing pattern and expression of a human septin gene on chromosome 17q25.3," Oncogene, 2001, pp. 5930-5939, vol. 20.

Mink et al., "A Novel Human Gene (SARM) at Chromosome 17q11 Encodes a Protein with a SAM Motif and Structural Similarity to Armadillo/β-Catenin That Is Conserved in Mouse, Drosophila, and Caenorhabditis elegans," Genomics, 2001, pp. 234-244, vol. 74.

Olek et al., "A modified and improved method for bisulphite based cytosine methylation analysis," Nucleic Acids Research, 1996, pp. 5064-5066, vol. 24.

Olek et al., "The pre-implantation ontogeny of the H19 methylation imprint," Nature Genetics, Nov. 1997, pp. 275-276, vol. 17.

Osaka et al., "MSF (MLL septin-like fusion), a fusion partner gene of MLL, in a therapy-related acute myeloid leukemia with a t(11;17)(q23:q25)," PNAS, May 1999, pp. 6428-6433, vol. 96.

Rein et al., "Identifying 5-methylcytosine and related modifications in DNA genomes," Nucleic Acids Research, 1998, pp. 2255-2284, vol. 26.

Russell et al., "Isolation and Mapping of a Human Septin Gene to a Region on Chromosome 17q, Commonly Deleted in Sporadic Epithelial Ovarian Tumors," Cancer Research, 2000, pp. 4729-4734, vol. 60.

Sabbioni et al., "Multigene Methylation Analysis of Gastrointestinal Tumors," Molecular Diagnosis, 2003, pp. 201-207, vol. 7.

Sadri et al., "Rapid analysis of DNA methylation using new restriction enzyme sites created by bisulfite modification," Nucleic Acids Research, 1996, pp. 5058-5059, vol. 24.

Sanger et al., "DNA sequencing with chain-terminating inhibitors," PNAS, Dec. 1977, pp. 5463-5467, vol. 74.

Scott et al., "Multimodality expression profiling shows SEPT9 to be overexpressed in a wide range of human tumours," Oncogene, 2005, pp. 4688-4700, vol. 24.

Surka et al., "The Mammalian Septin MSF Localizes with Microtubules and Is Required for Completion of Cytokinesis," Molecular Biology of the Cell, Oct. 2002, pp. 3532-3545, vol. 13.

Tomasini-Johansson et al., "Vitronectin in Colorectal Adenocarcinoma—Synthesis by Stromal Cells in Culture," Experimental Cell Research, 1994, pp. 303-312, vol. 214.

Toyota et al., "Identification of Differentially Methylated Sequences in Colorectal Cancer by Methylated CpG Island Amplification," Cancer Research, May 15, 1999, pp. 2307-2312, vol. 59.

Van Der Krol et al., "Modulation of Eukaryotic Gene Expression by Complementary RNA or DNA Sequences," BioTechniques, Nov.-Dec. 1988, pp. 958-976, vol. 6.

Wang et al., "p75 interacs with the Nogo receptor as a co-receptor for Nogo, MAG and OMgp," Nature, 2002, pp. 74-78, vol. 420.

Xiong et al., "COBRA: a sensitive and quantitative DNA methylation assay," Nucleic Acids Research, 1997, pp. 2532-2534, vol. 25.

Young et al., "HPP1: A transmembrane protein-encoding gene commonly methylated in colorectal polyps and cancers," PNAS, Jan. 2, 2001, pp. 265-270, vol. 98.

Yu et al., "Specific Inhibition of PCR by Non-Extendable Oligonucleotides Using a 5' to 3' Exonuclease-Deficient DNA Polymerase," BioTechniques, Oct. 1997, pp. 714-720, vol. 23.

Zeschnigk et al., "Imprinted segments in the human genome: different DNA methylation pattersn in the Prader-Willi/Angelman syndrome region as determined by the genomic sequencing method," Human Molecular Genetics, 1997, pp. 387-395, vol. 6.

Zeschnigk et al., "A single-tube PCR test for the diagnosis of Angelman and Prader-Willi syndrome based on allelic methylation differences at the SNRPN locus," European Journal of Human Genetics, Mar.-Apr. 1997, pp. 94-98, vol. 5.

Zon, "Oligonucleotide Analogues as Potential Chemotherapeutic Agents," Pharmaceutical Research, Sep. 1988, pp. 539-549, vol. 5.

Bibikova et al., "High-throughput DNA methylation profiling using universal bead arrays," Genome Research, 2006, pp. 383-393, vol. 16.

Database EMBL, "Homo sapiens chromosome 17, clone RP11-936I5," Database Accession No. AC111182, Feb. 18, 2002.

De Vos et al., "Circulating Methylated SEPT9 DNA in Plasma Is a Biomarker for Colorectal Cancer," Clinical Chemistry, 2009, vol. 55.

Eckhardt et al., "DNA methylation profiling of human chromosomes 6, 20 and 22," Nature Genetics, 2006, pp. 1378-1385, vol. 38.

Frigola et al., "Epigenetic remodeling in colorectal cancer results in coordinate gene suppression across an entire chromosome band," Nature Genetics, 2006, pp. 540-549, vol. 38.

Grutzmann et al., "Sensitive Detection of Colorectal Cancer in Peripheral Blood by Septin 9 DNA Methylation Assay," PloS ONE, 2008, p. e3759, vol. 3.

Lofton-Day et al., "DNA Methylation Biomarkers for Blood-Based Colorectal Cancer Screening," Clinical Chemistry, 2008, pp. 414-423, vol. 54.

Taylor et al., "Ultradeep Bisulfite Sequencing Analysis of DNA Methylation Patterns in Multiple Gene Promoters by 454 Sequencing," Cancer Research, 2007, pp. 8511-8518, vol. 67.

Zhang et al., "DNA Methylation Analysis of Chromosome 21 Gene Promoters at Single Base Pair and Single Allele Resolution," PloS Genetics, 2009, p. e1000438, vol. 5.

* cited by examiner

METHODS AND NUCLEIC ACIDS FOR ANALYSIS OF CELLULAR PROLIFERATIVE DISORDERS

CROSS-REFERENCE TO RELATED APPLICATIONS

The present application is a nationalization submission under 35 U.S.C. 371, and claims the benefit of priority to International Application PCT/US2006/014131, filed 17 Apr. 2006, which claims the benefit of priority to U.S. Provisional Patent Application Nos.: 60/672,242, filed 15 Apr. 2005; 60/676,997, filed 02 May 2005; 60/697,521, filed 08 Jul. 2005; 60/704,860, filed 01 Aug. 2005; 60/709,318, filed 17 Aug. 2005; 60/723,602, filed 04 Oct. 2005; and 60/787,402, filed 30 Mar. 2006; all of which are incorporated by reference herein in their entireties.

FIELD OF THE INVENTION

The present invention relates to genomic DNA sequences that exhibit altered expression patterns in disease states relative to normal. Particular embodiments provide, inter alia, novel methods, nucleic acids, nucleic acid arrays and kits useful for detecting, or for detecting and differentiating between or among cell proliferative disorders. Preferably, the methods, nucleic acids, nucleic acid arrays and kits for the detection and diagnosis of cell proliferative disorders are used for the diagnosis of cancer and in particular colorectal and/or liver cancer.

SEQUENCE LISTING

A Sequence Listing, pursuant to 37 C.F.R. §1.52(e)(5), has been provided on compact disc (1 of 1) as a 1.82 MB text file, entitled "47675-187 Sequence Listing.txt," and which is incorporated by reference herein in its entirety.

BACKGROUND

Incidence and diagnosis of cancer. Cancer is the second leading cause of death of the United States. Mortality rates could be significantly improved if current screening methods would be improved in terms of patient compliance, sensitivity and ease of screening. Current recommended methods for diagnosis of cancer are often expensive and are not suitable for application as population wide screening tests.

Hepatocellular cancer (HCC) is the fourth most common cancer in the world, its incidence varies from 2.1 per 100,000 in North America to 80 per 100,000 in China. In the United States, it is estimated that there will be 17,550 new cases diagnosed in 2005 and 15,420 deaths due to this disease. Ultrasound of the liver, alpha fetoprotein levels and conventional CT scan are regularly obtained in the diagnostic evaluation of HCC (hepatocellular cancer or primary liver cancer), but they are often too insensitive to detect multi-focal small lesions and for treatment planning.

In the United States the annual incidence of colorectal cancer is approximately 150,000, with 56,600 individuals dying form colorectal cancer each year. The lifetime risk of colorectal cancer in the general population is about 5 to 6 percent. Despite intensive efforts in recent years in screening and early detection of colon cancer, until today most cases are diagnosed in an advanced stage with regional or distant metastasis. While the therapeutic options include surgery and adjuvant or palliative chemotherapy, most patients die from progression of their cancer within a few months. Identifying the molecular changes that underlie the development of colon cancer may help to develop new monitoring, screening, diagnostic and therapeutic options that could improve the overall poor prognosis of these patients.

The current guidelines for colorectal screening according to the American Cancer Society utilizes one of five different options for screening in average risk individuals 50 years of age or older. These options include 1) fecal occult blood test (FOBT) annually, 2) flexible sigmoidoscopy every five years, 3) annual FPBT plus flexible sigmoidoscopy every five years, 4) double contrast barium enema (DCBE) every five years or 5) colonoscopy every ten years. Even though these testing procedures are well accepted by the medical community, the implementation of widespread screening for colorectal cancer has not been realized. Patient compliance is a major factor for limited use due to the discomfort or inconvenience associated with the procedures. FOBT testing, although a non-invasive procedure, requires dietary and other restrictions 3-5 days prior to testing. Sensitivity levels for this test are also very low for colorectal adenocarcinoma with wide variability depending on the trial. Sensitivity measurements for detection of adenomas is even less since most adenomas do not bleed. In contrast, sensitivity for more invasive procedures such as sigmoidoscopy and colonoscopy are quite high because of direct visualization of the lumen of the colon. No randomized trials have evaluated the efficacy of these techniques, however, using data from case-control studies and data from the National Polyp Study (U.S.) it has been shown that removal of adenomatous polyps results in a 76-90% reduction in CRC incidence. Sigmoidoscopy has the limitation of only visualizing the left side of the colon leaving lesions in the right colon undetected. Both scoping procedures are expensive, require cathartic preparation and have increased risk of morbidity and mortality. Improved tests with increased sensitivity, specificity, ease of use and decreased costs are clearly needed before general widespread screening for colorectal cancer becomes routine.

Early colorectal cancer detection is generally based on the fecal occult blood test (FOBT) performed annually on asymptomatic individuals. Current recommendations adapted by several healthcare organizations, including the American Cancer Society, call for fecal occult blood testing beginning at age 50, repeated annually until such time as the patient would no longer benefit from screening. A positive FOBT leads to colonoscopic examination of the bowel; an expensive and invasive procedure, with a serious complication rate of one per 5,000 examinations. Only 12% of patients with heme positive stool are diagnosed with cancer or large polyps at the time of colonoscopy. A number of studies show that FOBT screening does not improve cancer-related mortality or overall survival. Compliance with occult blood testing has been poor; less than 20 percent of the population is offered or completes FOBT as recommended. If FOBT is properly done, the patient collects a fecal sample from three consecutive bowel movements. Samples are obtained while the patient adheres to dietary guidelines and avoids medications known to induce occult gastrointestinal bleeding. In reality, physicians frequently fail to instruct patients properly, patients frequently fail to adhere to protocol, and some patients find the task of collecting fecal samples difficult or unpleasant, hence compliance with annual occult blood testing is poor. If testing sensitivity and specificity can be improved over current methods, the frequency of testing could be reduced, collection of consecutive samples would be eliminated, dietary and medication schedule modifications would be eliminated, and patient compliance would be enhanced. Compounding the problem of compliance, the sensitivity and specificity of FOBT to detect colon cancer is poor. Poor test specificity leads to unnecessary colonoscopy, adding considerable expense to colon cancer screening.

Specificity of the FOBT has been calculated at best to be 96%, with a sensitivity of 43% (adenomas) and 50% (colorectal carcinoma). Sensitivity can be improved using an immunoassay FOBT such as that produced under the tradename 'InSure™', with an improved sensitivity of 77% (adenomas) and 88.9% (colorectal carcinoma.

Molecular disease markers. Molecular disease markers offer several advantages over other types of markers, one advantage being that even samples of very small sizes and/or samples whose tissue architecture has not been maintained can be analyzed quite efficiently. Within the last decade a number of genes have been shown to be differentially expressed between normal and colon carcinomas. However, no single or combination of marker has been shown to be sufficient for the diagnosis of colon carcinomas. High-dimensional mRNA based approaches have recently been shown to be able to provide a better means to distinguish between different tumor types and benign and malignant lesions. However its application as a routine diagnostic tool in a clinical environment is impeded by the extreme instability of mRNA, the rapidly occurring expression changes following certain triggers (e.g., sample collection), and, most importantly, the large amount of mRNA needed for analysis (Lipshutz, R. J. et al., Nature Genetics 21:20-24, 1999; Bowtell, D. D. L. Nature genetics suppl. 21:25-32, 1999), which often cannot be obtained from a routine biopsy.

The use of biological markers to further improve sensitivity and specificity of FOBT has been suggested, examples of such tests include the PreGen-Plus™ stool analysis assay available from EXACT Sciences which has a sensitivity of 20% (adenoma) and 52% (colorectal carcinoma) and a specificity of 95% in both cases. This test assays for the presence of 23 DNA mutations associated with the development of colon neoplasms. The use of DNA methylation as colon cancer markers is known. For example Sabbioni et al. (*Molecular Diagnosis* 7:201-207, 2003) detected hypermethylation of a panel of genes consisting TPEF, HIC1, DAPK and MGMT in peripheral blood in 98% of colon carcinoma patients. However, this does provide a suitable basis for a commercially marketable test, as the specificity of such a test must also be sufficiently high.

The current model of colorectal pathogenesis favours a stepwise progression of adenomas, which includes the development of dysplasia and finally signs of invasive cancer. The molecular changes underlying this adenoma-carcinoma sequence include genetic and epigenetic alterations of tumor suppressor genes (APC, p53, DCC), the activation of oncogenes (K-ras) and the inactivation of DNA mismatch repair genes. Recently, further molecular changes and genetic defects have been revealed. Thus, activation of the Wnt signalling pathway not only includes mutations of the APC gene, but may also result from β-catenin mutations. Furthermore, alterations in the TGF-β signalling pathway together with its signal transducers SMAD4 and SMAD2 have been linked to the development of colon cancer.

Despite recent progress in the understanding of the pathogenesis of adenomas and carcinomas of the colon and their genetic and molecular changes, the genetic and epigenetic changes underlying the development of metastasis are less well understood. It is, however, generally well accepted that the process of invasion and proteolysis of the extracellular matrix, as well as infiltration of the vascular basement membrane involve adhesive proteins, such as members of the family of integrin receptors, the cadherins, the immunoglobulin superfamily, the laminin binding protein and the CD44 receptor. Apart from adhesion, the process of metastasis formation also includes the induction and regulation of angiogenesis (VEGF, bFGF), the induction of cell proliferation (EGF, HGF, IGF) and the activation of proteolytic enzymes (MMPs, TIMPs, uPAR), as well as the inhibition of apoptosis (Bcl-2, Bcl-X). More recently other groups have compared the genetic and molecular changes in metastatic lesions to the changes found in primary colorectal cancers. Thus, Kleeff et al. reported the loss of DOC-2, a candidate tumor suppressor gene, both in primary and metastatic colorectal cancer. Furthermore, Zauber et al. reported that in their series of 42 colorectal cancers Ki-ras mutations in the primary cancers were identical in all of the 42 paired primary and synchronous metastatic lesions. Similarly loss of heterozygosity at the APC locus was identical for 39 paired carcinomas and synchronous metastasis. The authors concluded that for Ki-ras and APC genes the genetic changes in metastasis are identical to the primary colorectal cancer. However, other groups have found genetic and molecular changes in metastatic colon cancers, that are not present in the primary cancers. Thus, the development of LOH of chromosome 3p in colorectal metastasis has been reported. In addition, using comparative genomic hybridization several alterations were found in liver metastasis that were unique to metastatic lesions (−9q, −11q, and −17q).

CpG island methylation. Apart from mutations aberrant methylation of CpG islands has been shown to lead to the transcriptional silencing of certain genes that have been previously linked to the pathogenesis of various cancers. CpG islands are short sequences which are rich in CpG dinucleotides and can usually be found in the 5' region of approximately 50% of all human genes. Methylation of the cytosines in these islands leads to the loss of gene expression and has been reported in the inactivation of the X chromosome and genomic imprinting.

Recently several groups have also analysed the methylation of various genes in colorectal cancer and reported the transcriptional silencing by promoter methylation for p16INK4, p14ARF, p15INK4b, MGMT, hMLH1, GSTP1, DAPK, CDH1, TIMP-3 and APC among others. Thus apart from mutational inactivation of certain genes, the hypermethylation of these genes also contributes significantly to the pathogenesis of this disease.

In recent years several genes that are methylated in colon cancer have been identified by MS-APPCR. This group of genes, among others, includes TPEF/HPP1 which is frequently methylated in colon cancers and which was independently identified by two different groups using the MS-APPCR method (see, e.g., Young J, Biden K G, Simms L A, Huggard P, Karamatic R, Eyre H J, Sutherland G R, Herath N, Barker M, Anderson G J, Fitzpatrick D R, Ramm G A, Jass J R, Leggett B A. HPP1: a transmembrane protein-encoding gene commonly methylated in colorectal polyps and cancers. *Proc Natl Acad Sci USA* 98:265-270, 2001).

Multifactorial approach. Cancer diagnostics has traditionally relied upon the detection of single molecular markers (e.g., gene mutations, elevated PSA levels). Unfortunately, cancer is a disease state in which single markers have typically failed to detect or differentiate many forms of the disease. Thus, assays that recognize only a single marker have been shown to be of limited predictive value. A fundamental aspect of this invention is that methylation-based cancer diagnostics and the screening, diagnosis, and therapeutic monitoring of such diseases will provide significant improvements over the state-of-the-art that uses single marker analyses by the use of a selection of multiple markers. The multiplexed analytical approach is particularly well suited for cancer diagnostics since cancer is not a simple disease, this multi-factorial "panel" approach is consistent with the heterogeneous nature of cancer, both cytologically and clinically.

Key to the successful implementation of a panel approach to methylation based diagnostic tests is the design and development of optimized panels of markers that can characterize and distinguish disease states. The present invention describes a plurality of particularly efficient and unique panels of genes, the methylation analysis of one or a combination of the members of the panel enabling the detection of colon cell proliferative disorders with a particularly high sensitivity, specificity and/or predictive value. Development of medical tests. Two key evaluative measures of any medical screening or diagnostic test are its sensitivity and specificity, which measure how well the test performs to accurately detect all affected individuals without exception, and without falsely including individuals who do not have the target disease (predicitive value). Historically, many diagnostic tests have been criticized due to poor sensitivity and specificity.

A true positive (TP) result is where the test is positive and the condition is present. A false positive (FP) result is where the test is positive but the condition is not present. A true negative (TN) result is where the test is negative and the condition is not present. A false negative (FN) result is where the test is negative but the condition is not present. In this context: Sensitivity=TP/(TP+FN); Specificity=TN/(FP+TN); and Predictive value=TP/(TP+FP).

Sensitivity is a measure of a test's ability to correctly detect the target disease in an individual being tested. A test having poor sensitivity produces a high rate of false negatives, i.e., individuals who have the disease but are falsely identified as being free of that particular disease. The potential danger of a false negative is that the diseased individual will remain undiagnosed and untreated for some period of time, during which the disease may progress to a later stage wherein treatments, if any, may be less effective. An example of a test that has low sensitivity is a protein-based blood test for HIV. This type of test exhibits poor sensitivity because it fails to detect the presence of the virus until the disease is well established and the virus has invaded the bloodstream in substantial numbers. In contrast, an example of a test that has high sensitivity is viral-load detection using the polymerase chain reaction (PCR). High sensitivity is achieved because this type of test can detect very small quantities of the virus. High sensitivity is particularly important when the consequences of missing a diagnosis are high.

Specificity, on the other hand, is a measure of a test's ability to identify accurately patients who are free of the disease state. A test having poor specificity produces a high rate of false positives, i.e., individuals who are falsely identified as having the disease. A drawback of false positives is that they force patients to undergo unnecessary medical procedures treatments with their attendant risks, emotional and financial stresses, and which could have adverse effects on the patient's health. A feature of diseases which makes it difficult to develop diagnostic tests with high specificity is that disease mechanisms, particularly in cancer, often involve a plurality of genes and proteins. Additionally, certain proteins may be elevated for reasons unrelated to a disease state. n example of a test that has high specificity is a gene-based test that can detect a p53 mutation. Specificity is important when the cost or risk associated with further diagnostic procedures or further medical intervention are very high.

Pronounced need in the art. It is generally accepted that there is a pronounced need in the art for improved screening and early detection of cancers. As an example, if colon cancer screening specificity can be increased, the problem of false positive test results leading to unnecessary colonoscopic examination would be reduced leading to cost savings and improved safety.

In view of the incidence of cancers in general and more particularly the disadvantages associated with current colorectal and hepatocellular cell proliferative disorder screening methods there is a substantial need in the art for improved methods for the early detection of cancer, in particular colon cancer, to be used in addition to or as a substitute for currently available tests.

Background of the genes of the present invention. The human Septin 9 gene (also known as MLL septin-like fusion protein, MLL septin-like fusion protein MSF-A, Slpa, Eseptin, Msf, septin-like protein Ovarian/Breast septin (Ov/Br septin) and Septin D1) is located on chromosome 17q25 within contig AC068594.15.1.168501 and is a member of the Septin gene family. FIG. 1 provides the Ensembl annotation of the Septin 9 gene, and shows 4 transcript variants, the Septin 9 variants and the Q9HC74 variants (which are truncated versions of the Septin 9 transcripts). SEQ ID NO: 1 provides the sequence of said gene, comprising regions of both the Septin 9 and Q9HC74 transcripts and promoter regions. SEQ ID NO:2 and SEQ ID NO:3 are sub-regions thereof that provide the sequence of CpG rich promoter regions of Septin 9 and Q9HC74 transcripts respectively.

It has been postulated that members of the Septin gene family are associated with multiple cellular functions ranging from vesicle transport to cytokinesis. Disruption of the action of Septin 9 results in incomplete cell division, see Surka, M. C., Tsang, C. W., and Trimble, W. S. Mol Biol Cell, 13: 3532-45 (2002). Septin 9 and other proteins have been shown to be fusion partners of the proto-oncogene MLL suggesting a role in tumorogenesis, see Osaka, M, Rowley, J. D. and Zeleznik-Le, N. J. PNAS, 96:6428-6433 (1999). Burrows et al. reported an in depth study of expression of the multiple isoforms of the Septin 9 gene in ovarian cancer and showed tissue specific expression of various transcripts, see Burrows, J. F., Chanduloy, et al. S.E.H. Journal of Pathology, 201:581-588 (2003).

A recent study (post-priority date published prior art) of over 7000 normal and tumor tissues indicates that there is consistent over-expression of Septin 9 isoforms in a number of tumor tissues, see Scott, M., Hyland, P. L., et al. Oncogene, 24: 4688-4700 (2005). The authors speculate that the gene is likely a type II cancer gene where changes in RNA transcript processing control regulation of different protein products, and the levels of these altered protein isoforms may provide answers to the gene's role in malignancy.

The MSF (migration stimulating factor) protein transcribed from the FN1 gene has also been implicated in carcinogenesis (see WO99/31233), however it should be noted that this protein is not the subject of the present application, and is currently not known to be associated with the Septin 9/MSF gene and transcribed products thereof.

From the references cited above it can be seen that the biological mechanisms linking said gene to tumorigenesis remain unclear. In WO 2004/074441 it is claimed that increased copy number and over-expression of the gene is a marker of cancer, and further provides means for diagnosis and treatment thereof according to said observation. WO 2004/074441 is accordingly the closest prior art as it has the greatest number of features in common with the method and nucleic acids of the present invention, and because it relates to the same field (cancer diagnosis). A major difference between the present invention and that of WO 2004/074441 is that the present invention shows for the first time that under-expression of the gene Septin 9 is associated with cancer. More particularly this is illustrated by means of methylation analysis. The correlation between expression and DNA methylation, and methods for determining DNA methylation are known in the art (see WO 99/28498). Nonetheless, it would not be obvious to the person skilled in the art that underexpression would be also associated with the development of cancer, in particular as WO 2004/074441 describes the modulation of said expression to lower levels as a potential therapy for cancer.

SEQ ID NO: 28 provides a CpG rich sequence located on chromosome 17q in the overlapping promotor regions of the Vitronectin (VTN, OMIM 193190, Accession number NM_000638) and SARM genes (Steril Alpha And Heat/Armadillo Motifs-Containing Protein, OMIM 607732).

The VTN gene encodes a 75-kD glycoprotein (also called serum spreading factor or complement S-protein) that promotes attachment and spreading of animal cells in vitro, inhibits cytolysis by the complement C5b-9 complex, and modulates antithrombin III-thrombin action in blood coagulation. Higher expression of Vitronectin has been observed in colon cancer cells (Exp Cell Res. 1994 September; 214(1): 303-12.). Furthermore, expression of this gene has been linked to progression and invasiveness of cancer cells. It is suggest that VTN is activated in tumours and blocking of the vitronectin receptor by a specific peptide reduces tumour size (Bloemendal H J, de Boer H C, Koop E A, van Dongen A J, Goldschmeding R, Landman W J, Logtenberg T, Gebbink M F, Voest E E. Cancer Immunol Immunother. 2004 September; 53(9):799-808.; Haier J, Goldmann U, Hotz B, Runkel N, Keilholz U. Clin Exp Metastasis. 2002; 19(8):665-72.).

The SARM protein consists of 690 amino acids and contains a 65-amino acid sterile alpha (SAM) domain surrounded by short HEAT/armadillo repeat sequences. Northern blot analysis has shown that the SARM antisense RNA is detectable at elevated levels in cancer cell lines irrespective of the tissue origin or metastatic potential (Mink, M.; Fogelgren, B.; Olszewski, K.; Maroy, P.; Csiszar, K. *Genomics* 74: 234-244, 2001.). Said study further demonstrated that the protein-encoding SARM transcript was only expressed one prostate carcinoma cell line of those studied.

SEQ ID NO: 24 provides a CpG rich sequence located on chromosome 3q23, downstream of the gene Forkhead Transcription Factor L2 gene (FOXL2, Pituitary Forkhead Factor, OMIM 605597). SEQ ID NO:24 has heretofore not been associated with cancer of any type. FOXL2 coding region is highly conserved among mammals. Immunohistochemical evidence indicates that FOXL2 is a nuclear protein specifically expressed in eyelids and in fetal and adult ovarian follicular cells. It is suggested that FOXL2 may play a role in ovarian somatic cell differentiation and in further follicle development and/or maintenance (J. Med. Genet. 39: 916-922, 2002.).

Moreover, mutations in the FOXL2 gene are associated with the blepharophimosis/ptosis/epicanthus inversus syndrome (BPES), a syndrome which affects the eyelids and the ovary (Am. J. Hum. Genet. 72: 478-487, 2003.; Hum. Mutat. 24: 189-193, 2004). The FOXL2 gene has heretofore not been associated with cancer, however other members of the FOX family have been implicated in oncogenesis. The FOXA1 gene is amplified and overexpressed in esophageal and lung cancer, the FOXM1 gene is up-regulated in pancreatic cancer and basal cell carcinoma due to the transcriptional regulation by Sonic Hedgehog (SHH) pathway.

SEQ ID NO: 27 presents part of the Six6 (Homeobox protein SIX6) gene, located on Chromosome 14q, synonyms include Homeodomain protein OPTX2, Optic homeobox 2, OPTX2, Sine oculis homeobox homolog 6, sine oculis homeobox homolog 6 (Drosophila), Six9, SIX9. The Six6 gene is associated in development pathways and its aberrant expression has been linked T-cell acute lymphoblastic leukemia oncogenesis.

SEQ ID NO: 25 is located on chromosome 17q21.31 and comprises the promotor region of the NGFR gene as well as parts of the NGFR gene itself (Nerve Growth Factor Receptor also known as p75, OMIM 162010). NGFR binds alone or in combination with other receptors to neurotrophins and neurite outgrowth inhibitory factors. It has been shown that NGFR plays a role in apoptosis, in myelination of peripheral nerves and in inhibition of central nervous system regeneration after axon lesion (Dobrowsky, R. T.; Werner, M. H.; Castellino, A. M.; Chao, M. V.; Hannun, Y. A. *Science* 265: 1596-1599, 1994; Cosgaya, J. M.; Chan, J. R.; Shooter, E. M. *Science* 298: 1245-1248, 2002; Wang, K. C.; Kim, J. A.; Sivasankaran, R.; Segal, R.; He, Z. Nature 420: 74-78, 2002.). Methylation of the NGFR gene has previously been associated with the development of colon cancer (PCT/US04/020336).

SEQ ID NO: 26 is located on chromosome 17q21.31 and comprises the promoter region of the gene TMEFF2. Methylation of TMEFF2 has been linked to colon cancer Cancer Res. 2000 Sep. 1; 60(17):4907-12.

SUMMARY OF THE INVENTION

The present invention provides a method for detecting and/or classifying cell proliferative disorders in a subject comprising determining the expression levels of at least one gene or genomic sequence selected from the group consisting of Septin 9 (including all transcript variants thereof), FOXL2, SARM1, VTN, PRDM6, NR2 μl, FAT and SEQ ID NOS:160 to SEQ ID NO:165 in a biological sample isolated from said subject wherein underexpression and/or CpG methylation is indicative of the presence or class of said disorder. Various aspects of the present invention provide an efficient and unique genetic marker, whereby expression analysis of said marker enables the detection of cellular proliferative disorders with a particularly high sensitivity, specificity and/or predictive value. Furthermore, said marker enables the differentiation of neoplastic cellular proliferative disorders (including pre-cancerous conditions) from benign cellular proliferative disorders. The marker of the present invention is particularly suited for detection of colorectal and hepatocellular carcinomas. In the context of colorectal carcinoma the inventive testing methods have particular utility for the screening of at-risk populations. The inventive methods have advantages over prior art methods (including the industry standard FOBT), because of improved sensitivity, specificity and likely patient compliance.

The methods and nucleic acids of the present invention are most preferably utilised for detecting liver cancer or distinguishing it from other liver cell proliferative disorders or for detecting colorectal carcinoma or pre-cancerous colorectal cell proliferative disorders.

In one embodiment the invention provides a method for detecting and/or classifying cell proliferative disorders in a subject comprising determining the expression levels of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165 in a biological sample isolated from said subject wherein underexpression and/or CpG methylation is indicative of the presence or class of said disorder. In one embodiment said expression level is determined by detecting the presence, absence or level of mRNA transcribed from said gene. In a further embodiment said expression level is determined by detecting the presence, absence or level of a polypeptide encoded by said gene or sequence thereof In a further preferred embodiment said expression is determined by detecting the presence or absence of CpG methylation within said gene, wherein the presence of methylation indicates the presence of a cell proliferative disorder. Said method comprises the following steps: i) contacting genomic DNA isolated from a biological sample (preferably selected from the group consisting of blood plasma, blood serum, whole blood, isolated blood cells, cells isolated from the blood) obtained from the subject with at least one reagent, or series of reagents that distinguishes between methylated and non-methylated CpG dinucleotides within at least one target region of the genomic DNA, wherein the nucleotide sequence of said target region comprises at least one CpG dinucleotide sequence of at least one gene or genomic sequence selected from the group consisting of Septin 9 (including all transcript variants thereof), FOXL2, SARM1, VTN, PRDM6, NR2 µl, FAT and SEQ ID NO: 160 to SEQ ID NO: 165; and ii) detecting and/or classifying cell proliferative disorders, at least in part. Preferably the target region comprises, or hybridizes under stringent conditions to a sequence of at least 16 contiguous nucleotides of at least one sequence selected from the group consisting of SEQ ID NOS:1 to SEQ ID NO3, SEQ ID NO:24, SEQ ID NO:28, SEQ ID NOS:159 to SEQ ID NO:167.

Preferably, the sensitivity of said detection is from about 75% to about 96%, or from about 80% to about 90%, or from about 80% to about 85%. Preferably, the specificity is from about 75% to about 96%, or from about 80% to about 90%, or from about 80% to about 85%.

The method is novel as no methods currently exist that enable the detection of cancer by analysis of body fluids, with a sensitivity and specificity high enough for use in a commercially available and regulatory body approved assay. For example, current methods used to detect and diagnose colorectal carcinoma include colonoscopy, sigmoidoscopy, and fecal occult blood colon cancer. In comparison to these methods, the disclosed invention is much less invasive than colonoscopy, and as, if not more sensitive than sigmoidoscopy and FOBT. The development of a body fluid assay represents a clear technical advantage over current methods known in the art in that it is anticipated that at least for colorectal carcinoma screening patient compliance for a single body fluid based test will be higher than the triplicate analysis of stool currently recommended for FOBT.

As a further illustration current methods used to detect and diagnose liver cancers include PET and MRI imaging and cytology screening of aspirate or biopsy. Radiological screening methods do not usually detect cancers at early stages and are expensive and time consuming to carry out. Cytological screening presents risks associated with biopsy (internal bleeding) and aspiration (needle-track seeding and hemorrhage, bile peritonitis, and pneumothorax) Accordingly, detection of liver cancer at an early stage is currently not possible, furthermore as patient prognosis is greatly improved by early detection there exists a need in the art for such a screening test.

A particular embodiment the method comprises the use of at least one gene or genomic sequence selected from the group consisting of Septin 9 (including all transcript variants thereof, FOXL2, SARM1, VTN, PRDM6, NR2 µl, FAT and SEQ ID NOS:160 to SEQ ID NO:165 as a marker for the detection and distinguishing of cellular proliferative disorders. The present invention is particularly suited for the detection of neoplastic cellular proliferative disorders (including at the pre-neoplastic stage). Furthermore the methods and nucleic acids of the present invention enable the differentiation of malignant from benign cellular proliferative disorders. The methods and nucleic acids of the present invention are particularly effective in the detection of colorectal or liver neoplastic disorders and pre-neoplastic. Furthermore they have utility in differentiating between neoplastic and benign cellular proliferative colorectal and hepatocellular disorders.

Said use of the gene may be enabled by means of any analysis of the expression of the gene, by means of mRNA expression analysis or protein expression analysis. However, in the most preferred embodiment of the invention, the detection, differentiation and distinguishing of colorectal or liver cell proliferative disorders is enabled by means of analysis of the methylation status of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165, and its promoter or regulatory elements.

The invention provides a method for the analysis of biological samples for features associated with the development of cellular proliferative disorders, the method characterised in that at least one nucleic acid, or a fragment thereof, from the group consisting of SEQ ID NOS:1 to SEQ ID NO:3, SEQ ID NO:24, SEQ ID NO:28, SEQ ID NOS:159 to SEQ ID NO:167 is contacted with a reagent or series of reagents capable of distinguishing between methylated and non methylated CpG dinucleotides within the genomic sequence, or sequences of interest.

The present invention provides a method for ascertaining epigenetic parameters of genomic DNA associated with the development of neoplastic cellular proliferative disorders (e.g., cancers). The method has utility for the improved diagnosis, treatment and monitoring of said diseases.

Preferably, the source of the test sample is selected from the group consisting of cells or cell lines, histological slides, biopsies, paraffin-embedded tissue, body fluids, ejaculate, stool, urine, blood, and combinations thereof. More preferably, the source is selected from the group consisting of stool, blood plasma, blood serum, whole blood, isolated blood cells, cells isolated from the blood obtained from the subject.

Specifically, the present invention provides a method for detecting neoplastic cellular proliferative disorders (preferably colorectal and/or liver cell) including at the early pre-cancerous stage, and for differentiating between neoplastic and benign cellular proliferative disorders, comprising: obtaining a biological sample comprising genomic nucleic acid(s); contacting the nucleic acid(s), or a fragment thereof, with one reagent or a plurality of reagents sufficient for distinguishing between methylated and non methylated CpG dinucleotide sequences within at least one target sequence of the subject nucleic acid, wherein the target sequence comprises, or hybridises under stringent conditions to, a sequence comprising at least 16 contiguous nucleotides of a sequence selected from the group consisting SEQ ID NOS:1 to SEQ ID NO3, SEQ ID NO:24, SEQ ID NO:28, SEQ ID NOS:159 to SEQ ID NO:167, said contiguous nucleotides comprising at least one CpG dinucleotide sequence; and determining, based at least in part on said distinguishing, the methylation state of at least one target CpG dinucleotide sequence, or an average, or a value reflecting an average methylation state of a plurality of target CpG dinucleotide sequences.

Preferably, distinguishing between methylated and non methylated CpG dinucleotide sequences within the target sequence comprises methylation state-dependent conversion or non-conversion of at least one such CpG dinucleotide sequence to the corresponding converted or non-converted dinucleotide sequence within a sequence selected from the group consisting of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203, and contiguous regions thereof corresponding to the target sequence.

Additional embodiments provide a method for the detection of neoplastic cellular proliferative disorders (or distinguishing them from benign cellular proliferative disorders), most preferably colorectal or hepatocellular, comprising: obtaining a biological sample having subject genomic DNA; extracting the genomic DNA; treating the genomic DNA, or a fragment thereof, with one or more reagents to convert 5-position unmethylated cytosine bases to uracil or to another base that is detectably dissimilar to cytosine in terms of hybridization properties; contacting the treated genomic DNA, or the treated fragment thereof, with an amplification enzyme and at least two primers comprising, in each case a contiguous sequence at least 9 nucleotides in length that is complementary to, or hybridizes under moderately stringent or stringent conditions to a sequence selected from the group consisting SEQ ID NOS: 10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS: 168 to SEQ ID NO:203, and complements thereof, wherein the treated DNA or the fragment thereof is either amplified to produce an amplificate, or is not amplified; and determining, based on a presence or absence of, or on a property of said amplificate, the methylation state or an average, or a value reflecting an average of the methylation level of at least one, but more preferably a plurality of CpG dinucleotides of a sequence selected from the group consisting of SEQ ID NO:1 to SEQ ID NO:3, SEQ ID NO:24, SEQ ID NO:28, SEQ ID NOS:159 to SEQ ID NO:167.

Preferably, determining comprises use of at least one method selected from the group consisting of: I) hybridizing at least one nucleic acid molecule comprising a contiguous sequence at least 9 nucleotides in length that is complementary to, or hybridizes under moderately stringent or stringent conditions to a sequence selected from the group consisting of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS: 168 to SEQ ID NO:203, and complements thereof; ii) hybridizing at least one nucleic acid molecule, bound to a solid phase, comprising a contiguous sequence at least 9 nucleotides in length that is complementary to, or hybridizes under moderately stringent or stringent conditions to a sequence selected from the group consisting of SEQ ID NOS:10 to SEQ ID NO:15, SEQ ID NOS:28 to SEQ ID NO:33, SEQ ID NO: 30 to SEQ ID NO: 31, SEQ ID NO: 42 to SEQ ID NO: 43, SEQ ID NO: 38 to SEQ ID NO: 39, SEQ ID NO: 50 to SEQ ID NO: 51, SEQ ID NO:168 to SEQ ID NO:203, and complements thereof; iii) hybridizing at least one nucleic acid molecule comprising a contiguous sequence at least 9 nucleotides in length that is complementary to, or hybridizes under moderately stringent or stringent conditions to a sequence selected from the group consisting of SEQ ID NO:10 to SEQ ID NO 15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203, and complements thereof, and extending at least one such hybridized nucleic acid molecule by at least one nucleotide base; and iv) sequencing of the amplificate.

Further embodiments provide a method for the analysis (i.e., detection and/or classification) of cell proliferative disorders, comprising: obtaining a biological sample having subject genomic DNA; extracting the genomic DNA; contacting the genomic DNA, or a fragment thereof, comprising one or more sequences selected from the group consisting of SEQ ID NOS:1 to SEQ ID NO:3, SEQ ID NO:24, SEQ ID NO:28, SEQ ID NOS:159 to SEQ ID NO:167 or a sequence that hybridizes under stringent conditions thereto, with one or more methylation-sensitive restriction enzymes, wherein the genomic DNA is either digested thereby to produce digestion fragments, or is not digested thereby; and determining, based on a presence or absence of, or on property of at least one such fragment, the methylation state of at least one CpG dinucleotide sequence of at least one genomic sequence selected form the group consisting of SEQ ID NOS:1 to SEQ ID NO:3, SEQ ID NO:24, SEQ ID NO:28, SEQ ID NOS:159 to SEQ ID NO:167, or an average, or a value reflecting an average methylation state of a plurality of CpG dinucleotide sequences thereof. Preferably, the digested or undigested genomic DNA is amplified prior to said determining.

Additional embodiments provide novel genomic and chemically modified nucleic acid sequences, as well as oligonucleotides and/or PNA-oligomers for analysis of cytosine methylation patterns within sequences from the group consisting of SEQ ID NOS:1 to SEQ ID NO:3, SEQ ID NO:24, SEQ ID NO:28, SEQ ID NOS:159 to SEQ ID NO:167.

BRIEF DESCRIPTION OF THE DRAWINGS

FIGS. 5 to 12 provide an overview of the sequencing of the bisulfite converted amplificates of the genomic sequence according to Table 21 in 4 samples that had previously been quantified (by HeavyMethyl assay) as having between 10% and 20% methylation.

FIGS. 13 to 20 provide an overview of the sequencing of the bisulfite converted amplificate of the genomic sequence according to Table 21 in 2 samples that had previously been quantified (by HeavyMethyl™ assay) as having greater than 20% methylation.

FIGS. 21 to 22 provide an overview of the sequencing of the bisulfite converted amplificate of the genomic sequence according to Table 21 in blood samples from 3 healthy subjects.

FIGS. 23 to 29 provide an overview of the sequencing of the bisulfite converted amplificate of the genomic sequence according to Table 21 in 6 samples that had previously been quantified (by HeavyMethyl assay) as having less than 10% (but greater than 0%) methylation.

DETAILED DESCRIPTION OF THE INVENTION

Definitions

Figure 1:
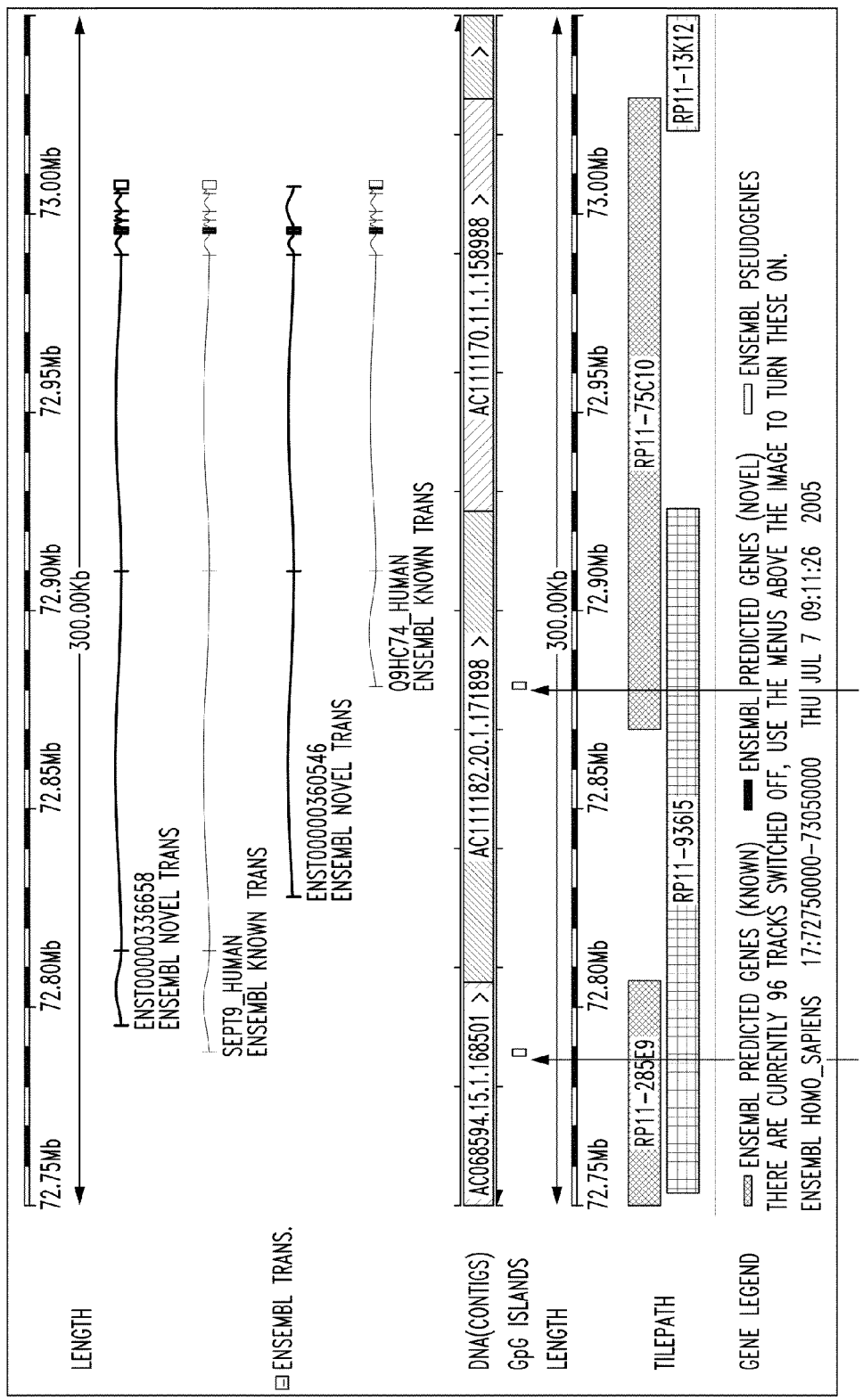
FIG. 1 shows the Ensembl human genome annotation of the Septin 9 and Q9HC74 gene transcripts. The relative locations of SEQ ID NO:2 and SEQ ID NO:3 are also shown.
Figure 2:
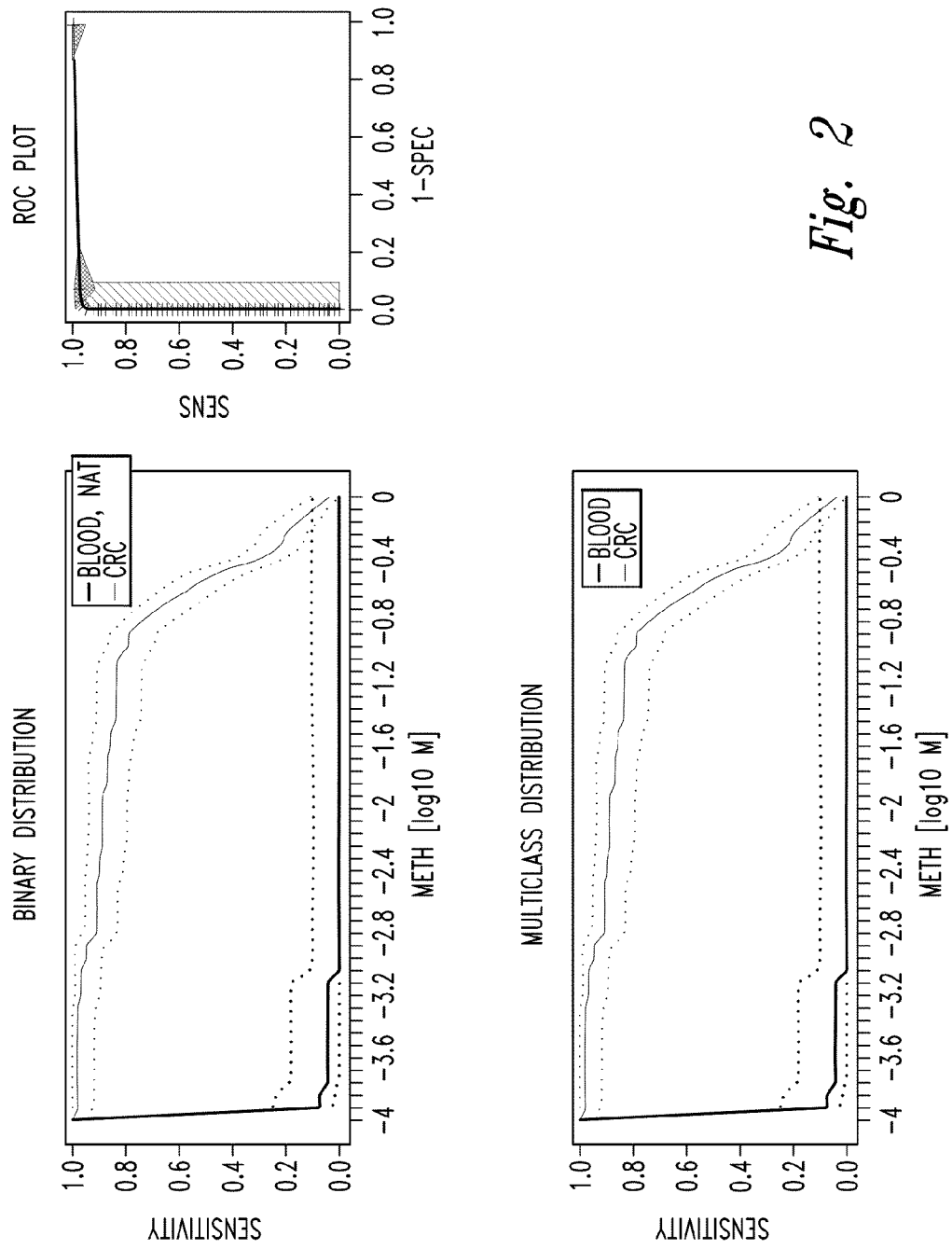
FIG. 2 provides three plots. The two plots on the left show the sensitivity of the assay of SEQ ID NO:1 (Assay 2) in colorectal carcinoma and blood samples in Example 2. The plot to the right provides a ROC of the colorectal carcinoma detection.

The term "Observed/Expected Ratio" ("O/E Ratio") refers to the frequency of CpG dinucleotides within a particular DNA sequence, and corresponds to the [number of CpG sites/(number of C bases×number of G bases)]/band length for each fragment.

The term "CpG island" refers to a contiguous region of genomic DNA that satisfies the criteria of (1) having a frequency of CpG dinucleotides corresponding to an "Observed/Expected Ratio">0.6, and (2) having a "GC Content">0.5. CpG islands are typically, but not always, between about 0.2 to about 1 KB, or to about 2 kb in length.

The term "methylation state" or "methylation status" refers to the presence or absence of 5-methylcytosine ("5-mCyt") at one or a plurality of CpG dinucleotides within a DNA sequence. Methylation states at one or more particular CpG methylation sites (each having two CpG dinucleotide sequences) within a DNA sequence include "unmethylated," "fully-methylated" and "hemi-methylated."

The term "hemi-methylation" or "hemimethylation" refers to the methylation state of a double stranded DNA wherein only one strand thereof is methylated.

The term 'AUC' as used herein is an abbreviation for the area under a curve. In particular it refers to the area under a Receiver Operating Characteristic (ROC) curve. The ROC curve is a plot of the true positive rate against the false positive rate for the different possible cut points of a diagnostic test. It shows the trade-off between sensitivity and specificity depending on the selected cut point (any increase in sensitivity will be accompanied by a decrease in specificity). The area under an ROC curve (AUC) is a measure for the accuracy of a diagnostic test (the larger the area the better, optimum is 1, a random test would have a ROC curve lying on the diagonal with an area of 0.5; for reference: J. P. Egan. Signal Detection Theory and ROC Analysis, Academic Press, New York, 1975).

The term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample.

The term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

The term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as mutations are, in particular, insertions, deletions, point mutations, inversions and polymorphisms and, particularly preferred, SNPs (single nucleotide polymorphisms).

"Epigenetic parameters" are, in particular, cytosine methylation. Further epigenetic parameters include, for example, the acetylation of histones which, however, cannot be directly analysed using the described method but which, in turn, correlate with the DNA methylation.

The term "bisulfite reagent" refers to a reagent comprising bisulfite, disulfite, hydrogen sulfite or combinations thereof, useful as disclosed herein to distinguish between methylated and unmethylated CpG dinucleotide sequences.

The term "Methylation assay" refers to any assay for determining the methylation state of one or more CpG dinucleotide sequences within a sequence of DNA.

The term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

The term "MethyLight™" refers to the art-recognized fluorescence-based real-time PCR technique described by Eads et al., *Cancer Res.* 59:2302-2306, 1999.

The term "HeavyMethyl™" assay, in the embodiment thereof implemented herein, refers to an assay, wherein methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers.

The term "Ms-SNuPE" (Methylation-sensitive Single Nucleotide Primer Extension) refers to the art-recognized assay described by Gonzalgo & Jones, *Nucleic Acids Res.* 25:2529-2531, 1997.

The term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

The term "COBRA" (Combined Bisulfite Restriction Analysis) refers to the art-recognized methylation assay described by Xiong & Laird, *Nucleic Acids Res.* 25:2532-2534, 1997.

The term "MCA" (Methylated CpG Island Amplification) refers to the methylation assay described by Toyota et al., *Cancer Res.* 59:2307-12, 1999, and in WO 00/26401A1.

The term "hybridisation" is to be understood as a bond of an oligonucleotide to a complementary sequence along the lines of the Watson-Crick base pairings in the sample DNA, forming a duplex structure.

"Stringent hybridisation conditions," as defined herein, involve hybridising at 68° C. in 5×SSC/5×Denhardt's solution/1.0% SDS, and washing in 0.2×SSC/0.1% SDS at room temperature, or involve the art-recognized equivalent thereof (e.g., conditions in which a hybridisation is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

The terms "Methylation-specific restriction enzymes" or "methylation-sensitive restriction enzymes" shall be taken to mean an enzyme that selectively digests a nucleic acid dependant on the methylation state of its recognition site. In the case of such restriction enzymes which specifically cut if the recognition site is not methylated or hemimethylated, the cut will not take place, or with a significantly reduced efficiency, if the recognition site is methylated. In the case of such restriction enzymes which specifically cut if the recognition site is methylated, the cut will not take place, or with a significantly reduced efficiency if the recognition site is not methylated. Preferred are methylation-specific restriction enzymes, the recognition sequence of which contains a CG dinucleotide (for instance cgcg or cccggg). Further preferred for some embodiments are restriction enzymes that do not cut if the cytosine in this dinucleotide is methylated at the carbon atom C5.

"Non-methylation-specific restriction enzymes" or "non-methylation-sensitive restriction enzymes" are restriction enzymes that cut a nucleic acid sequence irrespective of the methylation state with nearly identical efficiency. They are also called "methylation-unspecific restriction enzymes."

The term "gene" shall be taken to include all transcript variants thereof (e.g. the term "Septin 9" shall include for example its truncated transcript Q9HC74) and all promoter and regulatory elements thereof. Furthermore as a plurality of SNPs are known within said gene the term shall be taken to include all sequence variants thereof.

The term "pre-cancerous" or "pre-neoplastic" and equivalents thereof shall be taken to mean any cellular proliferative disorder which is undergoing malignant transformation. Examples of such conditions include, in the context of colorectal cellular proliferative disorders, cellular proliferative disorders with a high degree of dysplasia and the following classes of adenomas:

Level 1: penetration of malignant glands through the muscularis mucosa into the submucosa, within the polyp head;

Level 2: the same submucosal invasion, but present at the junction of the head to the stalk;

Level 3: invasion of the stalk; and

Level 4: invasion of the stalk's base at the connection to the colonic wall (this level corresponds to stage Dukes A).

Overview

The present invention provides a method for detecting and/or classifying cell proliferative disorders in a subject comprising determining the expression levels of at least one gene or genomic sequence selected from the group consisting of Septin 9 (including all transcript variants thereof), FOXL2, SARM1, VTN, PRDM6, NR2 µl, FAT and SEQ ID NOS:160 to SEQ ID NO:165 in a biological sample isolated from said subject wherein underexpression and/or CpG methylation is indicative of the presence or class of said disorder. Said markers may be used for the diagnosis of neoplastic cellular proliferative disorders (cancer), including early detection during the pre-cancerous stages of the disease, and furthermore for the differentiation of neoplastic from benign cellular proliferative disorders. The present invention discloses a method wherein a neoplastic cell proliferative disorder is distinguished from a benign cell proliferative disorder said method characterized in that underexpression and/or the presence of CpG methylation is indicative of the presence of a neoplastic cell proliferative disorder or pre-neoplastic disorder and the absence thereof is indicative of the presence of a benign cell proliferative disorder.

The markers of the present invention are particularly efficient in detecting or distinguishing between liver cell proliferative disorders or alternatively for detecting or distinguishing between colorectal cell proliferative disorders, thereby providing improved means for the early detection, classification and treatment of said disorders.

In addition to the embodiments above wherein the methylation analysis of at least one gene or genomic sequence selected from the group consisting of Septin 9 (including all transcript variants thereof), FOXL2, SARM1, VTN, PRDM6, NR2 µl, FAT and SEQ ID NOS:160 to SEQ ID NO:165 is analysed, the invention presents further panels of genes comprising at least one gene or genomic sequence selected from the group consisting of Septin 9 (including all transcript variants thereof), FOXL2, SARM1, VTN, PRDM6, NR2 µl, FAT and SEQ ID NOS:160 to SEQ ID NO:165 with novel utility for the detection of cancers, in particular liver and/or colorectal cancer.

In a first further embodiment the present invention is based upon the analysis of CpG methylation status of at least one gene or genomic sequence selected from the group consisting of Septin 9 (including all transcript variants thereof), FOXL2, SARM1, VTN, PRDM6, NR2 µl, FAT and SEQ ID NOS:160 to SEQ ID NO:165. It is further preferred that the sequences of said genes are as according to TABLE 1.

Bisulfite modification of DNA is an art-recognized tool used to assess CpG methylation status. 5-methylcytosine is the most frequent covalent base modification in the DNA of eukaryotic cells. It plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing, because 5-methylcytosine has the same base pairing behavior as cytosine. Moreover, the epigenetic information carried by 5-methylcytosine is completely lost during, e.g., PCR amplification.

The most frequently used method for analyzing DNA for the presence of 5-methylcytosine is based upon the specific reaction of bisulfite with cytosine whereby, upon subsequent alkaline hydrolysis, cytosine is converted to uracil which corresponds to thymine in its base pairing behavior. Significantly, however, 5-methylcytosine remains unmodified under these conditions. Consequently, the original DNA is converted in such a manner that methylcytosine, which originally could not be distinguished from cytosine by its hybridization behavior, can now be detected as the only remaining cytosine using standard, art-recognized molecular biological techniques, for example, by amplification and hybridization, or by sequencing. All of these techniques are based on differential base pairing properties, which can now be fully exploited.

The prior art, in terms of sensitivity, is defined by a method comprising enclosing the DNA to be analysed in an agarose matrix, thereby preventing the diffusion and renaturation of the DNA (bisulfite only reacts with single-stranded DNA), and replacing all precipitation and purification steps with fast dialysis (Olek A, et al., A modified and improved method for bisulfite based cytosine methylation analysis, *Nucleic Acids Res.* 24:5064-6, 1996). It is thus possible to analyse individual cells for methylation status, illustrating the utility and sensitivity of the method. An overview of art-recognized methods for detecting 5-methylcytosine is provided by Rein, T., et al., *Nucleic Acids Res.,* 26:2255, 1998.

The bisulfite technique, barring few exceptions (e.g., Zeschnigk M, et al., *Eur J Hum Genet.* 5:94-98, 1997), is currently only used in research. In all instances, short, specific fragments of a known gene are amplified subsequent to a bisulfite treatment, and either completely sequenced (Olek & Walter, *Nat. Genet.* 1997 17:275-6, 1997), subjected to one or more primer extension reactions (Gonzalgo & Jones, *Nucleic Acids Res.,* 25:2529-31, 1997; WO 95/00669; U.S. Pat. No. 6,251,594) to analyse individual cytosine positions, or treated by enzymatic digestion (Xiong & Laird, *Nucleic Acids Res.,* 25:2532-4, 1997). Detection by hybridisation has also been described in the art (Olek et al., WO 99/28498). Additionally, use of the bisulfite technique for methylation detection with respect to individual genes has been described (Grigg & Clark, *Bioessays,* 16:431-6, 1994; Zeschnigk M, et al., *Hum Mol. Genet.,* 6:387-95, 1997; Feil R, et al., *Nucleic Acids Res.,* 22:695-, 1994; Martin V, et al., *Gene,* 157:261-4, 1995; WO 9746705 and WO 9515373).

The present invention provides for the use of the bisulfite technique, in combination with one or more methylation assays, for determination of the methylation status of CpG dinucleotide sequences within at least one sequence selected from the group consisting SEQ ID NOS:1 to SEQ ID NO:3, SEQ ID NO:24, SEQ ID NO:28, SEQ ID NOS:159 to SEQ ID NO:167. Genomic CpG dinucleotides can be methylated or unmethylated (alternatively known as up- and down-methylated respectively). However the methods of the present invention are suitable for the analysis of biological samples of a heterogeneous nature, e.g., a low concentration of tumor cells within a background of blood or stool. Accordingly, when analyzing the methylation status of a CpG position within such a sample the person skilled in the art may use a quantitative assay for determining the level (e.g., percent, fraction, ratio, proportion or degree) of methylation at a particular CpG position as opposed to a methylation state. Accordingly the term methylation status or methylation state should also be taken to mean a value reflecting the degree of methylation at a CpG position. Unless specifically stated the terms "hypermethylated" or "upmethylated" shall be taken to mean a methylation level above that of a specified cut-off point, wherein said cut-off may be a value representing the average or median methylation level for a given population, or is preferably an optimized cut-off level. The "cut-off" is also referred herein as a "threshold". In the context of the present invention the terms "methylated", "hypermethylated" or "upmethylated" shall be taken to include a methylation level above the cut-off be zero (0) % (or equivalents thereof) methylation for all CpG positions within and associated with (e.g. in promoter or regulatory regions) the genes or genomic sequence selected from the group consisting of Septin 9 (including all transcript variants thereof), FOXL2, SARM1, VTN, PRDM6, NR2E1, FAT and SEQ ID NOS:160 to SEQ ID NO:165.

According to the present invention, determination of the methylation status of CpG dinucleotide sequences within SEQ ID NOS:1 to SEQ ID NO:3, SEQ ID NO:24, SEQ ID NO:28, SEQ ID NOS:159 to SEQ ID NO:167 has utility both in the diagnosis and characterization of cellular proliferative disorders. Methylation Assay Procedures. Various methylation assay procedures are known in the art, and can be used in conjunction with the present invention. These assays allow for determination of the methylation state of one or a plurality of CpG dinucleotides (e.g., CpG islands) within a DNA sequence. Such assays involve, among other techniques, DNA sequencing of bisulfite-treated DNA, PCR (for sequence-specific amplification), Southern blot analysis, and use of methylation-sensitive restriction enzymes.

For example, genomic sequencing has been simplified for analysis of DNA methylation patterns and 5-methylcytosine distribution by using bisulfite treatment (Frommer et al., *Proc. Natl. Acad. Sci. USA* 89:1827-1831, 1992). Additionally, restriction enzyme digestion of PCR products amplified from bisulfite-converted DNA is used, e.g., the method described by Sadri & Hornsby (*Nucl. Acids Res.* 24:5058-5059, 1996), or COBRA (Combined Bisulfite Restriction Analysis) (Xiong & Laird, *Nucleic Acids Res.* 25:2532-2534, 1997).

COBRA. COBRA™ analysis is a quantitative methylation assay useful for determining DNA methylation levels at specific gene loci in small amounts of genomic DNA (Xiong & Laird, *Nucleic Acids Res.* 25:2532-2534, 1997). Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (*Proc. Natl. Acad. Sci. USA* 89:1827-1831, 1992). PCR amplification of the bisulfite converted DNA is then performed using primers specific for the CpG islands of interest, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. In addition, this technique can be reliably applied to DNA obtained from microdissected paraffin-embedded tissue samples.

Typical reagents (e.g., as might be found in a typical COBRA™-based kit) for COBRA™ analysis may include, but are not limited to: PCR primers for specific gene (or bisulfite treated DNA sequence or CpG island); restriction enzyme and appropriate buffer; gene-hybridization oligonucleotide; control hybridization oligonucleotide; kinase labeling kit for oligonucleotide probe; and labeled nucleotides. Additionally, bisulfite conversion reagents may include: DNA denaturation buffer; sulfonation buffer; DNA recovery reagents or kits (e.g., precipitation, ultrafiltration, affinity column); desulfonation buffer; and DNA recovery components.

Preferably, assays such as "MethyLight™" (a fluorescence-based real-time PCR technique) (Eads et al., *Cancer Res.* 59:2302-2306, 1999), Ms-SNuPE™ (Methylation-sensitive Single Nucleotide Primer Extension) reactions (Gonzalgo & Jones, *Nucleic Acids Res.* 25:2529-2531, 1997), methylation-specific PCR ("MSP"; Herman et al., *Proc. Natl. Acad. Sci. USA* 93:9821-9826, 1996; U.S. Pat. No. 5,786,146), and methylated CpG island amplification ("MCA"; Toyota et al., *Cancer Res.* 59:2307-12, 1999) are used alone or in combination with other of these methods.

The "HeavyMethyl™" assay, technique is a quantitative method for assessing methylation differences based on methylation specific amplification of bisulfite treated DNA. Methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers. The HeavyMethyl™ assay may also be used in combination with methylation specific amplification primers.

Typical reagents (e.g., as might be found in a typical MethyLight□-based kit) for HeavyMethyl™ analysis may include, but are not limited to: PCR primers for specific genes (or bisulfite treated DNA sequence or CpG island); blocking oligonucleotides; optimized PCR buffers and deoxynucleotides; and Taq polymerase.

MSP. MSP (methylation-specific PCR) allows for assessing the methylation status of virtually any group of CpG sites within a CpG island, independent of the use of methylation-sensitive restriction enzymes (Herman et al. *Proc. Natl. Acad. Sci. USA* 93:9821-9826, 1996; U.S. Pat. No. 5,786,146). Briefly, DNA is modified by sodium bisulfite converting all unmethylated, but not methylated cytosines to uracil, and subsequently amplified with primers specific for methylated versus unmethylated DNA. MSP requires only small quantities of DNA, is sensitive to 0.1% methylated alleles of a given CpG island locus, and can be performed on DNA extracted from paraffin-embedded samples. Typical reagents (e.g., as might be found in a typical MSP-based kit) for MSP analysis may include, but are not limited to: methylated and unmethylated PCR primers for specific gene (or bisulfite treated DNA sequence or CpG island), optimized PCR buffers and deoxynucleotides, and specific probes.

MethyLight™. The MethyLight™ assay is a high-throughput quantitative methylation assay that utilizes fluorescence-based real-time PCR (TaqMan®) technology that requires no further manipulations after the PCR step (Eads et al., Cancer Res. 59:2302-2306, 1999). Briefly, the MethyLight™ process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed in a "biased" (with PCR primers that overlap known CpG dinucleotides) reaction. Sequence discrimination can occur both at the level of the amplification process and at the level of the fluorescence detection process.

The MethyLight™ assay may be used as a quantitative test for methylation patterns in the genomic DNA sample, wherein sequence discrimination occurs at the level of probe hybridization. In this quantitative version, the PCR reaction provides for a methylation specific amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The MethyLight™ process can by used with any suitable probes e.g. "TaqMan®", Lightcycler® etc. . . . For example, double-stranded genomic DNA is treated with sodium bisulfite and subjected to one of two sets of PCR reactions using TaqMan® probes; e.g., with MSP primers and/or HeavyMethyl blocker oligonucleotides and TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system.

Typical reagents (e.g., as might be found in a typical MethyLight™-based kit) for MethyLight™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

The QM™ (quantitative methylation) assay is an alternative quantitative test for methylation patterns in genomic DNA samples, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The QM™ process can by used with any suitable probes e.g. "TaqMan®", Lightcycler® etc . . . in the amplification process. For example, double-stranded genomic DNA is treated with sodium bisulfite and subjected to unbiased primers and the TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system. Typical reagents (e.g., as might be found in a typical QM™-based kit) for QM™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

Ms-SNuPE. The Ms-SNuPE™ technique is a quantitative method for assessing methylation differences at specific CpG sites based on bisulfite treatment of DNA, followed by single-nucleotide primer extension (Gonzalgo & Jones, *Nucleic Acids Res.* 25:2529-2531, 1997). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. Small amounts of DNA can be analyzed (e.g., microdissected pathology sections), and it avoids utilization of restriction enzymes for determining the methylation status at CpG sites.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for specific gene; reaction buffer (for the Ms-SNuPE reaction); and labelled nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

The Genomic Sequence According to SEQ ID NOS:1 TO SEQ ID NO:3, SEQ ID NO:24, SEQ ID NO:28, SEQ ID NOS:159 TO SEQ ID NO:167, and Non-naturally Occurring Treated Variants Thereof According to SEQ ID NOS:10 TO SEQ ID NO:15, SEQ ID NOS:28 TO SEQ ID NO:33, SEQ ID NOS:30 TO SEQ ID NO:31. SEQ ID NOS:42 TO SEQ ID NO:43, SEQ ID NOS:38 TO SEQ ID NO:39, SEQ ID NOS:50 TO SEQ ID NO:51, SEQ ID NOS:168 TO SEQ ID NO:203, were Determined to have Novel Utility for the Early Detection, Classification and/or Treatment of Cellular Proliferative Disorders, in Particular Colorectal and/or Liver Cell Proliferative Disorders In one embodiment the invention of the method comprises the following steps: i) contacting genomic DNA (preferably isolated from body fluids) obtained from the subject with at least one reagent, or series of reagents that distinguishes between methylated and non-methylated CpG dinucleotides within at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165 (including their promoter and regulatory regions); and ii) detecting, or detecting and distinguishing between or among colon or liver cell proliferative disorders afforded with a sensitivity of greater than or equal to 80% and a specificity of greater than or equal to 80%.

Preferably, the sensitivity is from about 75% to about 96%, or from about 80% to about 90%, or from about 80% to about 85%. Preferably, the specificity is from about 75% to about 96%, or from about 80% to about 90%, or from about 80% to about 85%.

Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants, e.g., by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA. All clinical sample types comprising neoplastic matter or pre-neoplastic matter are suitable for use in the present method, preferred are cell lines, histological slides, biopsies, paraffin-embedded tissue, body fluids, stool, colonic effluent, urine, blood plasma, blood serum, whole blood, isolated blood cells, cells isolated from the blood and combinations thereof. Body fluids are the preferred source of the DNA; particularly preferred are blood plasma, blood serum, whole blood, isolated blood cells and cells isolated from the blood.

The genomic DNA sample is then treated with at least one reagent, or series of reagents that distinguishes between methylated and non-methylated CpG dinucleotides within at least one target region of the genomic DNA, wherein the target region comprises, or hybridizes under stringent conditions to a sequence of at least 16 contiguous nucleotides of at least one sequence selected from the group consisting of SEQ ID NOS:1 to SEQ ID NO:3, SEQ ID NO:24, SEQ ID NO:28, SEQ ID NOS:159 to SEQ ID NO:167 respectively, wherein said contiguous nucleotides comprise at least one CpG dinucleotide sequence.

It is particularly preferred that said reagent converts cytosine bases which are unmethylated at the 5'-position to uracil, thymine, or another base which is dissimilar to cytosine in terms of hybridisation behaviour. However in an alternative embodiment said reagent may be a methylation sensitive restriction enzyme.

Wherein the genomic DNA sample is treated in such a manner that cytosine bases which are unmethylated at the 5'-position are converted to uracil, thymine, or another base which is dissimilar to cytosine in terms of hybridization behavior It is preferred that this treatment is carried out with bisulfite (hydrogen sulfite, disulfite) and subsequent alkaline hydrolysis. Such a treatment results in the conversion of SEQ ID NOS:1 to SEQ ID NO:3, SEQ ID NO:24, SEQ ID NO:28, SEQ ID NOS:159 to SEQ ID NO:167 to SEQ ID NOs:10 to SEQ ID NO:15, SEQ ID NOS:30 to SEQ ID NO:31, SEQ ID NOS:38 to SEQ ID NO:39, SEQ ID NOS:168 to SEQ ID NO:185, (respectively) wherein said CpG dinucleotides are methylated or SEQ ID NOS:28 to SEQ ID NO:33, SEQ ID NOs:42 to SEQ ID NO:43, SEQ ID NOS:50 to SEQ ID NO:51, SEQ ID NOS:186 to SEQ ID NO:203 wherein said CpG dinucleotides are unmethylated.

The treated DNA is then analysed in order to determine the methylation state of the target gene sequences (at least one gene or genomic sequence selected from the group consisting of Septin 9 (including all transcript variants thereof, FOXL2, SARM1, VTN, PRDM6, NR2E1, FAT and SEQ ID NOS:160 to SEQ ID NO:165 prior to the treatment). It is particularly preferred that the target region comprises, or hybridizes under stringent conditions to at least 16 contiguous nucleotides of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165. It is preferred that the sequence of said genes according to SEQ ID NOS:1 to SEQ ID NO:3, SEQ ID NO:24, SEQ ID NO:28, SEQ ID NOS:159 to SEQ ID NO:167 are analysed. The method of analysis may be selected from those known in the art, including those listed herein. Particularly preferred are MethyLight™, MSP and the use of blocking oligonucleotides (HeavyMethyl™) as described herein. It is further preferred that any oligonucleotides used in such analysis (including primers, blocking oligonucleotides and detection probes) should be reverse complementary, identical, or hybridise under stringent or highly stringent conditions to an at least 16-base-pair long segment of the base sequences of one or more of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 and sequences complementary thereto.

Aberrant methylation, more specifically hypermethylation of the genes or genomic sequence selected from the group consisting of Septin 9 (including all transcript variants thereof, FOXL2, SARM1, VTN, PRDM6, NR2 µl, FAT and SEQ ID NOS:160 to SEQ ID NO:165 (including their promoter and/or regulatory regions) is associated with the presence of neoplastic cellular proliferative disorders, and is particularly prevalent in colorectal and hepatocellular carcinomas. Accordingly wherein a biological sample presents within any degree of methylation, said sample should be determined as neoplastic.

Analysis of one the genes or genomic sequence selected from the group consisting of Septin 9 (including all transcript variants thereof), FOXL2, SARM1, VTN, PRDM6, NR2E1, FAT and SEQ ID NOS:160 to SEQ ID NO:165 enables for the first time detecting, or detecting and distinguishing between or among colon or liver cell proliferative disorders afforded with a sensitivity of greater than or equal to 80% and a specificity of greater than or equal to 80%. Sensitivity is calculated as: (detected neoplasia/all neoplasia; e.g., (detected colon neoplasia/all colon neoplasia); and specificity is calculated as (non-detected negatives/total negatives).

Preferably, the sensitivity is from about 75% to about 96%, or from about 80% to about 90%, or from about 80% to about 85%. Preferably, the specificity is from about 75% to about 96%, or from about 80% to about 90%, or from about 80% to about 85%.

Colon neoplasia is herein defined as all colon malignancies and adenomas greater than 1 cm., or subsets thereof. Negatives can be defined as healthy individuals.

In one embodiment the method discloses the use of at least one gene or genomic sequence selected from the group consisting of Septin 9 (including all transcript variants thereof, FOXL2, SARM1, VTN, PRDM6, NR2E1, FAT and SEQ ID NOS:160 to SEQ ID NO:165 (or promoter and/or regulatory regions thereof) as a marker for the differentiation, detection and distinguishing of cellular proliferative disorders (in particular neoplastic, colon or liver disorders).

Said method may be enabled by means of any analysis of the expression of an RNA transcribed therefrom or polypeptide or protein translated from said RNA, preferably by means of mRNA expression analysis or polypeptide expression analysis. Accordingly the present invention also provides diagnostic assays and methods, both quantitative and qualitative for detecting the expression of at least one gene or genomic sequence selected from the group consisting of Septin 9 (including all transcript variants thereof), FOXL2, SARM1, VTN, PRDM6, NR2 E1, FAT and SEQ ID NOS:160 to SEQ ID NO:165 in a subject and determining therefrom upon the presence or absence of cancer in said subject.

Aberrant expression of mRNA transcribed from the genes or genomic sequences selected from the group consisting of Septin 9 (including all transcript variants thereof), FOXL2, SARM1, VTN, PRDM6, NR2E1, FAT and SEQ ID NOS:160 to SEQ ID NO:165 are associated with the presence of cancer in a subject. According to the present invention, under expression (and/or presence methylation) is associated with the presence of cancer, and vice versa over-expression (and/or absence of methylation) is associated with the absence of cancer. It is particularly preferred that the expression of at least one of the transcript variants as disclosed in SEQ ID NOS:16 to SEQ ID NO:19 of the gene Septin 9 is determined.

To detect the presence of mRNA encoding a gene or genomic sequence, a sample is obtained from a patient. The sample may be any suitable sample comprising cellular matter of the tumour. Suitable sample types include cell lines, histological slides, biopsies, paraffin-embedded tissue, body fluids, stool, colonic effluent, urine, blood plasma, blood serum, whole blood, isolated blood cells, cells isolated from the blood and all possible combinations thereof. It is preferred that said sample types are stool or body fluids selected from the group consisting colonic effluent, urine, blood plasma, blood serum, whole blood, isolated blood cells, cells isolated from the blood.

The sample may be treated to extract the RNA contained therein. The resulting nucleic acid from the sample is then analysed. Many techniques are known in the state of the art for determining absolute and relative levels of gene expression, commonly used techniques suitable for use in the present invention include in situ hybridisation (e.g., FISH), Northern analysis, RNase protection assays (RPA), microarrays and PCR-based techniques, such as quantitative PCR and differential display PCR or any other nucleic acid detection method.

Particularly preferred is the use of the reverse transcription/polymerisation chain reaction technique (RT-PCR). The method of RT-PCR is well known in the art (for example, see Watson and Fleming, supra).

The RT-PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end oligonucleotide dT primer and/or random hexamer primers. The cDNA thus produced is then amplified by means of PCR. (Belyavsky et al, Nucl Acid Res 17:2919-2932, 1989; Krug and Berger, Methods in Enzymology, Academic Press, N.Y., Vol. 152, pp. 316-325, 1987 which are incorporated by reference). Further preferred is the "Real-time" variant of RT-PCR, wherein the PCR product is detected by means of hybridisation probes (e.g. TaqMan, Lightcycler, Molecular Beacons & Scorpion) or SYBR green. The detected signal from the probes or SYBR green is then quantitated either by reference to a standard curve or by comparing the Ct values to that of a calibration standard. Analysis of housekeeping genes is often used to normalize the results.

In Northern blot analysis total or poly(A)+ mRNA is run on a denaturing agarose gel and detected by hybridisation to a labelled probe in the dried gel itself or on a membrane. The resulting signal is proportional to the amount of target RNA in the RNA population.

Comparing the signals from two or more cell populations or tissues reveals relative differences in gene expression levels. Absolute quantitation can be performed by comparing the signal to a standard curve generated using known amounts of an in vitro transcript corresponding to the target RNA. Analysis of housekeeping genes, genes whose expression levels are expected to remain relatively constant regardless of conditions, is often used to normalize the results, eliminating any apparent differences caused by unequal transfer of RNA to the membrane or unequal loading of RNA on the gel.

The first step in Northern analysis is isolating pure, intact RNA from the cells or tissue of interest. Because Northern blots distinguish RNAs by size, sample integrity influences the degree to which a signal is localized in a single band. Partially degraded RNA samples will result in the signal being smeared or distributed over several bands with an overall loss in sensitivity and possibly an erroneous interpretation of the data. In Northern blot analysis, DNA, RNA and oligonucleotide probes can be used and these probes are preferably labelled (e.g., radioactive labels, mass labels or fluorescent labels). The size of the target RNA, not the probe, will determine the size of the detected band, so methods such as random-primed labelling, which generates probes of variable lengths, are suitable for probe synthesis. The specific activity of the probe will determine the level of sensitivity, so it is preferred that probes with high specific activities are used.

In an RNase protection assay, the RNA target and an RNA probe of a defined length are hybridised in solution. Following hybridisation, the RNA is digested with RNases specific for single-stranded nucleic acids to remove any unhybridized, single-stranded target RNA and probe. The RNases are inactivated, and the RNA is separated e.g. by denaturing polyacrylamide gel electrophoresis. The amount of intact RNA probe is proportional to the amount of target RNA in the RNA population. RPA can be used for relative and absolute quantitation of gene expression and also for mapping RNA structure, such as intron/exon boundaries and transcription start sites. The RNase protection assay is preferable to Northern blot analysis as it generally has a lower limit of detection.

The antisense RNA probes used in RPA are generated by in vitro transcription of a DNA template with a defined endpoint and are typically in the range of 50-600 nucleotides. The use of RNA probes that include additional sequences not homologous to the target RNA allows the protected fragment to be distinguished from the full-length probe. RNA probes are typically used instead of DNA probes due to the ease of generating single-stranded RNA probes and the reproducibility and reliability of RNA:RNA duplex digestion with RNases (Ausubel et al. 2003), particularly preferred are probes with high specific activities.

Particularly preferred is the use of microarrays. The microarray analysis process can be divided into two main parts. First is the immobilization of known gene sequences onto glass slides or other solid support followed by hybridisation of the fluorescently labelled cDNA (comprising the sequences to be interrogated) to the known genes immobilized on the glass slide (or other solid phase). After hybridisation, arrays are scanned using a fluorescent microarray scanner. Analysing the relative fluorescent intensity of different genes provides a measure of the differences in gene expression.

DNA arrays can be generated by immobilizing presynthesized oligonucleotides onto prepared glass slides or other solid surfaces. In this case, representative gene sequences are manufactured and prepared using standard oligonucleotide synthesis and purification methods. These synthesized gene sequences are complementary to the RNA transcript(s) of the genes of interest (in this case the genes or genomic sequences selected from the group consisting of Septin 9 (including all transcript variants thereof, FOXL2, SARM1, VTN, PRDM6, NR2E1, FAT and SEQ ID NOS:160 to SEQ ID NO:165) and tend to be shorter sequences in the range of 25-70 nucleotides. In a preferred embodiment said oligonucleotides or polynucleotides comprise at least 9, 18 or 25 bases of a sequence complementary to or hybridising to at least one sequence selected from the group consisting of SEQ ID NOS:16 to SEQ ID NO:19 and sequences complementary thereto. Alternatively, immobilized oligos can be chemically synthesized in situ on the surface of the slide. In situ oligonucleotide synthesis involves the consecutive addition of the appropriate nucleotides to the spots on the microarray; spots not receiving a nucleotide are protected during each stage of the process using physical or virtual masks. Preferably said synthesized nucleic acids are locked nucleic acids.

In expression profiling microarray experiments, the RNA templates used are representative of the transcription profile of the cells or tissues under study. RNA is first isolated from the cell populations or tissues to be compared. Each RNA sample is then used as a template to generate fluorescently labelled cDNA via a reverse transcription reaction. Fluorescent labelling of the cDNA can be accomplished by either direct labelling or indirect labelling methods. During direct labelling, fluorescently modified nucleotides (e.g., Cy®3- or Cy®5-dCTP) are incorporated directly into the cDNA during the reverse transcription. Alternatively, indirect labelling can be achieved by incorporating aminoallyl-modified nucleotides during cDNA synthesis and then conjugating an N-hydroxysuccinimide (NHS)-ester dye to the aminoallyl-modified cDNA after the reverse transcription reaction is complete. Alternatively, the probe may be unlabelled, but may be detectable by specific binding with a ligand which is labelled, either directly or indirectly. Suitable labels and methods for labelling ligands (and probes) are known in the art, and include, for example, radioactive labels which may be incorporated by known methods (e.g., nick translation or kinasing). Other suitable labels include but are not limited to biotin, fluorescent groups, chemiluminescent groups (e.g., dioxetanes, particularly triggered dioxetanes), enzymes, antibodies, and the like.

To perform differential gene expression analysis, cDNA generated from different RNA samples are labelled with Cy®3. The resulting labelled cDNA is purified to remove unincorporated nucleotides, free dye and residual RNA. Following purification, the labelled cDNA samples are hybridised to the microarray. The stringency of hybridisation is determined by a number of factors during hybridisation and during the washing procedure, including temperature, ionic strength, length of time and concentration of formamide. These factors are outlined in, for example, Sambrook et al. (Molecular Cloning: A Laboratory Manual, 2nd ed., 1989). The microarray is scanned post-hybridisation using a fluorescent microarray scanner. The fluorescent intensity of each spot indicates the level of expression of the analysed gene; bright spots correspond to strongly expressed genes, while dim spots indicate weak expression.

Once the images are obtained, the raw data must be analysed. First, the background fluorescence must be subtracted from the fluorescence of each spot. The data is then normalized to a control sequence, such as exogenously added nucleic acids (preferably RNA or DNA), or a housekeeping gene panel to account for any non-specific hybridisation, array imperfections or variability in the array set-up, cDNA labelling, hybridisation or washing. Data normalization allows the results of multiple arrays to be compared.

Another aspect of the invention relates to a kit for use in diagnosis of cancer in a subject according to the methods of the present invention, said kit comprising: a means for measuring the level of transcription of genes or genomic sequences selected from the group consisting of Septin 9 (including all transcript variants thereof), FOXL2, SARM1, VTN, PRDM6, NR2 µl, FAT and SEQ ID NOS:160 to SEQ ID NO:165. In a preferred embodiment the means for measuring the level of transcription comprise oligonucleotides or polynucleotides able to hybridise under stringent or moderately stringent conditions to the transcription products of a gene or genomic sequence selected from the group consisting of Septin 9 (including all transcript variants thereof), FOXL2, SARM1, VTN, PRDM6, NR2 µl, FAT and SEQ ID NOS:160 to SEQ ID NO:165. Preferably said oligonucleotides or polynucleotides are able to hybridise under stringent or moderately stringent conditions to at least one of the transcription products of a gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165 as provided in SEQ ID NOS:16 to SEQ ID NO:19. In one embodiment said oligonucleotides or polynucleotides comprise at least 9, 18 or 25 bases of a sequence complementary to or hybridising to at least one sequence selected from the group consisting of SEQ ID NOS:16 to SEQ ID NO:19 and sequences complementary thereto.

In a most preferred embodiment the level of transcription is determined by techniques selected from the group of Northern Blot analysis, reverse transcriptase PCR, real-time PCR, RNAse protection, and microarray. In another embodiment of the invention the kit further comprises means for obtaining a biological sample of the patient. Preferred is a kit, which further comprises a container which is most preferably suitable for containing the means for measuring the level of transcription and the biological sample of the patient, and most preferably further comprises instructions for use and interpretation of the kit results.

In a preferred embodiment the kit comprises (a) a plurality of oligonucleotides or polynucleotides able to hybridise under stringent or moderately stringent conditions to the transcription products of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165; (b) a container, preferably suitable for containing the oligonucleotides or polynucleotides and a biological sample of the patient comprising the transcription products wherein the oligonucleotides or polynucleotides can hybridise under stringent or moderately stringent conditions to the transcription products, (c) means to detect the hybridisation of (b); and optionally, (d) instructions for use and interpretation of the kit results. It is further preferred that said oligonucleotides or polynucleotides of (a) comprise in each case at least 9, 18 or 25 bases of a sequence complementary to or hybridising to at least one sequence selected from the group consisting of SEQ ID NOS:16 to SEQ ID NO:19 and sequences complementary thereto.

The kit may also contain other components such as hybridisation buffer (where the oligonucleotides are to be used as a probe) packaged in a separate container. Alternatively, where the oligonucleotides are to be used to amplify a target region, the kit may contain, packaged in separate containers, a polymerase and a reaction buffer optimised for primer extension mediated by the polymerase, such as PCR. Preferably said polymerase is a reverse transcriptase. It is further preferred that said kit further contains an Rnase reagent.

The present invention further provides for methods for the detection of the presence of the polypeptide encoded by said gene sequences in a sample obtained from a patient.

Aberrant levels of polypeptide expression of the polypeptides encoded by the genes or genomic sequences selected from the group consisting of Septin 9 (including all transcript variants thereof, FOXL2, SARM1, VTN, PRDM6, NR2E1, FAT and SEQ ID NOS:160 to SEQ ID NO:165 are associated with the presence of cancer.

According to the present invention, under expression of said polypeptides is associated with the presence of cancer. It is particularly preferred that said polypeptides are according to at least one of the amino acid sequences provided in SEQ ID NOS:20 to SEQ ID NO:23 polypeptides transcribed from the Septin 9 gene).

Any method known in the art for detecting polypeptides can be used. Such methods include, but are not limited to mass-spectrometry, immunodiffusion, immunoelectrophoresis, immunochemical methods, binder-ligand assays, immunohistochemical techniques, agglutination and complement assays (e.g., see Basic and Clinical Immunology, Sites and Terr, eds., Appleton & Lange, Norwalk, Conn. pp 217-262, 1991 which is incorporated by reference). Preferred are binder-ligand immunoassay methods including reacting antibodies with an epitope or epitopes and competitively displacing a labelled polypeptide or derivative thereof.

Certain embodiments of the present invention comprise the use of antibodies specific to the polypeptide encoded by a gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165. It is particularly preferred that said polypeptides are according to at least one of the amino acid sequences provided in SEQ ID NOS:20 to SEQ ID NO:23.

Such antibodies are useful for cancer diagnosis. In certain embodiments production of monoclonal or polyclonal antibodies can be induced by the use of an epitope encoded by a polypeptide of SEQ ID NOS:20 to SEQ ID NO:23 as an antigene. Such antibodies may in turn be used to detect expressed polypeptides as markers for cancer diagnosis. The levels of such polypeptides present may be quantified by conventional methods. Antibody-polypeptide binding may be detected and quantified by a variety of means known in the art, such as labelling with fluorescent or radioactive ligands. The invention further comprises kits for performing the above-mentioned procedures, wherein such kits contain antibodies specific for the investigated polypeptides.

Numerous competitive and non-competitive polypeptide binding immunoassays are well known in the art. Antibodies employed in such assays may be unlabelled, for example as used in agglutination tests, or labelled for use a wide variety of assay methods. Labels that can be used include radionuclides, enzymes, fluorescers, chemiluminescers, enzyme substrates or co-factors, enzyme inhibitors, particles, dyes and the like, Preferred assays include but are not limited to radio-immunoassay (RIA), enzyme immunoassays, e.g., enzyme-linked immunosorbent assay (ELISA), fluorescent immunoassays and the like. Polyclonal or monoclonal antibodies or epitopes thereof can be made for use in immunoassays by any of a number of methods known in the art.

In an alternative embodiment of the method the proteins may be detected by means of western blot analysis. Said analysis is standard in the art, briefly proteins are separated by means of electrophoresis, e.g., SDS-PAGE. The separated proteins are then transferred to a suitable membrane (or paper), e.g., nitrocellulose, retaining the spacial separation achieved by electrophoresis. The membrane is then incubated with a blocking agent to bind remaining sticky places on the membrane, commonly used agents include generic protein (e.g., milk protein). An antibody specific to the protein of interest is then added, said antibody being detectably labelled for example by dyes or enzymatic means (e.g., alkaline phosphatase or horseradish peroxidase). The location of the antibody on the membrane is then detected.

In an alternative embodiment of the method the proteins may be detected by means of immunohistochemistry (the use of antibodies to probe specific antigens in a sample). Said analysis is standard in the art, wherein detection of antigens in tissues is known as immunohistochemistry, while detection in cultured cells is generally termed immunocytochemistry. Briefly, the primary antibody to be detected by binding to its specific antigen. The antibody-antigen complex is then bound by a secondary enzyme conjugated antibody. In the presence of the necessary substrate and chromogen the bound enzyme is detected according to coloured deposits at the antibody-antigen binding sites. There is a wide range of suitable sample types, antigen-antibody affinity, antibody types, and detection enhancement methods. Thus optimal conditions for immunohistochemical or immunocytochemical detection must be determined by the person skilled in the art for each individual case.

One approach for preparing antibodies to a polypeptide is the selection and preparation of an amino acid sequence of all or part of the polypeptide, chemically synthesising the amino acid sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference in its entirety) Methods for preparation of the polypeptides or epitopes thereof include, but are no limited to chemical synthesis, recombinant DNA techniques or isolation from biologica samples.

In the final step of the method the diagnosis of the patient is determined whereby under-expression (of at least one gene or genomic sequence selected from the group consisting of Septin 9 (including all transcript variants thereof, FOXL2 SARM1, VTN, PRDM6, NR2E1, FAT and SEQ ID NOS:160 to SEQ ID NO:165) is indicative of the presence of cancer. The term under-expression shall be taken to mean expression at a detected level less than a pre-determined cut off which may be selected from the group consisting of the mean, median or an optimised threshold value.

Another aspect of the invention provides a kit for use in diagnosis of cancer in <subject according to the methods of the present invention, comprising: a means for detecting polypeptides at least one gene or genomic sequence selected from the group consisting of Septin 9 (including all transcript variants thereof), FOXL2, SARM1, VTN PRDM6, NR2E1, FAT and SEQ ID NOS:160 to SEQ ID NO:165. Preferably the sequence of said polypeptides is as provided in SEQ ID NOS:20 to SEQ ID NO: 23. The means for detecting the polypeptides comprise preferably antibodies, antibody derivatives, or antibody fragments. The polypeptides are most preferably detected by means of Western Blotting utilizing a labelled antibody. In another embodiment of the invention the kit further comprising means for obtaining a biological sample of the patient. Preferred is a kit, which further comprises a container suitable for containing the means for detecting the polypeptides in the biological sample of the patient, and most preferably further comprises instructions for use and interpretation of the ki results. In a preferred embodiment the kit comprises: (a) a means for detecting polypeptides at least one gene or genomic sequence selected from the group consisting of Septin 9 (including all transcript variants thereof), FOXL2, SARM1, VTN PRDM6, NR2E1, FAT and SEQ ID NOS:160 to SEQ ID NO:165; (b) a container suitable for containing the said means and the biological sample of the patient comprising the polypeptides wherein the means can form complexes with the polypeptides; (c) a means to detect the complexes of (b); and optionally (d) instructions for use and interpretation of the kit results. It is preferred that said means for detecting polypeptides of at least one gene or genomic sequence selected from the grout consisting of Septin 9 (including all transcript variants thereof), FOXL2, SARM1, VTN PRDM6, NR2E1, FAT and SEQ ID NOS:160 to SEQ ID NO:165 are specific for at least one of the polypeptide sequences selected from SEQ ID NOS:20 to SEQ ID NO:23. The kit may also contain other components such as buffers or solutions suitable for blocking, washing or coating, packaged in a separate container.

Particular embodiments of the present invention provide a novel application of the analysis of methylation levels and/or patterns within said sequences that enables a precise detection, characterisation and/or treatment of liver and/or colorectal cell proliferative disorders. Early detection of cancer is directly linked with disease prognosis, and the disclosed method thereby enables the physician and patient to make better and more informed treatment decisions.

Further Improvements

The present invention provides novel uses for the genomic sequence SEQ ID NOS:1 TO SEQ ID NO:3, SEQ ID NO:24, SEQ ID NO:28, SEQ ID NOS:159 TO SEQ ID NO:167. Additional embodiments provide modified variants of SEQ ID NOS:1 to SEQ ID NO:3, SEQ ID NO:24, SEQ ID NO:28, SEQ ID NOS:159 to SEQ ID NO:167, as well as oligonucleotides and/or PNA-oligomers for analysis of cytosine methylation patterns within SEQ ID NOS:1 to SEQ ID NO:3, SEQ ID NO:24, SEQ ID NO:28, SEQ ID NOS:159 to SEQ ID NO:167.

An objective of the invention comprises analysis of the methylation state of one or more CpG dinucleotides within at least one sequence selected form the group consisting of SEQ ID NOS:1 to SEQ ID NO:3, SEQ ID NO:24, SEQ ID NO:28, SEQ ID NOS:159 to SEQ ID NO:167 and sequences complementary thereto.

The disclosed invention provides treated nucleic acids, derived from genomic SEQ ID NOS:1 to SEQ ID NO:3, SEQ ID NO:24, SEQ ID NO:28, SEQ ID NO:159 to SEQ ID NO:167, wherein the treatment is suitable to convert at least one unmethylated cytosine base of the genomic DNA sequence to uracil or another base that is detectably dissimilar to cytosine in terms of hybridization. The genomic sequences in question may comprise one, or more consecutive methylated CpG positions. Said treatment preferably comprises use of a reagent selected from the group consisting of bisulfite, hydrogen sulfite, disulfite, and combinations thereof. In a preferred embodiment of the invention, the invention provides a non-naturally occurring modified nucleic acid comprising a sequence of at least 16 contiguous nucleotide bases in length of a sequence selected from the group consisting of SEQ ID NOS:10 to SEQ ID NO:15, SEQ ID NOS:28 to SEQ ID NO:33, SEQ ID NOS: 30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS: 168 to SEQ ID NO:203. In further preferred embodiments of the invention said nucleic acid is at least 50, 100, 150, 200, 250 or 500 base pairs in length of a segment of the nucleic acid sequence disclosed in SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203. Particularly preferred is a nucleic acid molecule that is not identical or complementary to all or a portion of the sequences SEQ ID NOS:10 to SEQ ID NO:15, SEQ ID NO:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 but not SEQ ID NOS:1 to SEQ ID NO:3, SEQ ID NO:24, SEQ ID NO:28, SEQ ID NOS:159 to SEQ ID NO:167 or other naturally occurring DNA.

It is preferred that said sequence comprises at least one CpG, TpA or CpA dinucleotide and sequences complementary thereto. The sequences of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 provide non-naturally occurring modified versions of the nucleic acid according to SEQ ID NOS:1 to SEQ ID NO:3, SEQ ID NO:24, SEQ ID NO:28, SEQ ID NOS: 159 to SEQ ID NO:

167, wherein the modification of each genomic sequence results in the synthesis of a nucleic acid having a sequence that is unique and distinct from said genomic sequence as follows. For each sense strand genomic DNA, e.g., SEQ ID NO:1, four converted versions are disclosed. A first version wherein "C" is converted to "T," but "CpG" remains "CpG" (i.e., corresponds to case where, for the genomic sequence, all "C" residues of CpG dinucleotide sequences are methylated and are thus not converted); a second version discloses the complement of the disclosed genomic DNA sequence (i.e. antisense strand), wherein "C" is converted to "T," but "CpG" remains "CpG" (i.e., corresponds to case where, for all "C" residues of CpG dinucleotide sequences are methylated and are thus not converted). The 'upmethylated' converted sequences of SEQ ID NOS:1 to SEQ ID NO:3, SEQ ID NO:24, SEQ ID NO:28, SEQ ID NOS:159 to SEQ ID NO:167 correspond to SEQ ID NOS:10 to SEQ ID NO:15, SEQ ID NOS: 30 to SEQ ID NO:31, SEQ ID NOS:38 to SEQ ID NO:39, SEQ ID NOS:168 to SEQ ID NO:185. A third chemically converted version of each genomic sequences is provided, wherein "C" is converted to "T" for all "C" residues, including those of "CpG" dinucleotide sequences (i.e., corresponds to case where, for the genomic sequences, all "C" residues of CpG dinucleotide sequences are unmethylated); a final chemically converted version of each sequence, discloses the complement of the disclosed genomic DNA sequence (i.e. antisense strand), wherein "C" is converted to "T" for all "C" residues, including those of "CpG" dinucleotide sequences (i.e., corresponds to case where, for the complement (antisense strand) of each genomic sequence, all "C" residues of CpG dinucleotide sequences are unmethylated). The 'downmethylated' converted sequences of SEQ ID NOS:1 to SEQ ID NO:3, SEQ ID NO:24, SEQ ID NO:28, SEQ ID NOS:159 to SEQ ID NO:167 correspond to SEQ ID NOS:28 to SEQ ID NO:33, SEQ ID NOS:42 to SEQ ID NO:43, SEQ ID NOS:50 to SEQ ID NO:51, SEQ ID NOS: 186 to SEQ ID NO:203.

Significantly, heretofore, the nucleic acid sequences and molecules according SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 were not implicated in or connected with the detection, classification or treatment of cellular proliferative disorders.

In an alternative preferred embodiment, the invention further provides oligonucleotides or oligomers suitable for use in the methods of the invention for detecting the cytosine methylation state within genomic or treated (chemically modified) DNA, according to SEQ ID NOS:1 to SEQ ID NO:3, SEQ ID NO:24, SEQ ID NO:28, SEQ ID NOS:159 to SEQ ID NO:167, SEQ ID NOS:10 to SEQ ID NO:15, SEQ ID NOS:28 to SEQ ID NO:33, SEQ ID NOS:30 to SEQ ID NO:31, SEQ ID NOD:42 to SEQ ID NO:43, SEQ ID NOD:38 to SEQ ID NO:39, SEQ ID NOS:50 to SEQ ID NO:51, SEQ ID NOS:168 to SEQ ID NO:203. Said oligonucleotide or oligomer nucleic acids provide novel diagnostic means. Said oligonucleotide or oligomer comprising a nucleic acid sequence having a length of at least nine (9) nucleotides which is identical to, hybridizes, under moderately stringent or stringent conditions (as defined herein above), to a treated nucleic acid sequence according to SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 and/or sequences complementary thereto, or to a genomic sequence according to SEQ ID NOS:1 to SEQ ID NO:3, SEQ ID NOS:24, SEQ ID NO:28, SEQ ID NOS:159 to SEQ ID NO:167 and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of a sequence selected form the group consisting of SEQ ID NOS:1 to SEQ ID NO:3, SEQ ID NO:24, SEQ ID NO:28, SEQ ID NOS:159 to SEQ ID NO:167, SEQ ID NOS: 10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 or to the complements thereof. Particularly preferred is a nucleic acid molecule that hybridizes under moderately stringent and/or stringent hybridization conditions to all or a portion of the sequences SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 but not SEQ ID NOS:1 to SEQ ID NO:3, SEQ ID NO:24, SEQ ID NO:28, SEQ ID NOS:159 to SEQ ID NO:167 or other human genomic DNA.

The identical or hybridizing portion of the hybridizing nucleic acids is typically at least 9, 16, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof of a sequence selected from the group consisting of SEQ ID NOS:1 to SEQ ID NO:3, SEQ ID NO:24, SEQ ID NO:28, SEQ ID NOS:159 to SEQ ID NO:167, SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO: 51, SEQ ID NOS:168 to SEQ ID NO:203, or to the complements thereof.

Hybridizing nucleic acids of the type described herein can be used, for example, as a primer (e.g., a PCR primer), or a diagnostic and/or prognostic probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of SEQ ID NOS:1 to SEQ ID NO:3, SEQ ID NO:24, SEQ ID NO:28, SEQ ID NOS:159 to SEQ ID NO:167 (such as allelic variants and SNPs), rather than identical, it is useful to first establish the lowest temperature at which only homologous hybridization occurs with a particular concentration of salt (e.g., SSC or SSPE). Then, assuming that 1% mismatching results in a 1° C. decrease in the Tm, the temperature of the final wash in the hybridization reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to, e.g., SEQ ID NO:1, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions:

n to (n+(X−1));

where n=1, 2, 3, . . . (Y−(X−1));

where Y equals the length (nucleotides or base pairs) of SEQ ID NO: 1 (219909);

where X equals the common length (in nucleotides) of each oligonucleotide in the set (e.g., X=20 for a set of consecutively overlapping 20-mers); and where the number (Z) of consecutively overlapping oligomers of length X for a given SEQ ID NO of length Y is equal to Y−(X−1). For example Z=219909−19=219890 for either sense or antisense sets of SEQ ID NO:1, where X=20.

Preferably, the set is limited to those oligomers that comprise at least one CpG, TpG or CpA dinucleotide.

Examples of inventive 20-mer oligonucleotides include the following set of 219890 oligomers (and the antisense set complementary thereto), indicated by polynucleotide positions with reference to SEQ ID NO:1:

1-20, 2-21, 3-22, 4-23, 5-24, . . . and 219890-219909.

Preferably, the set is limited to those oligomers that comprise at least one CpG, TpG or CpA dinucleotide.

Likewise, examples of inventive 25-mer oligonucleotides include the following set of 219885 oligomers (and the antisense set complementary thereto), indicated by polynucleotide positions with reference to SEQ ID NO: 1:

1-25, 2-26, 3-27, 4-28, 5-29, . . . and 219885-219909.

Preferably, the set is limited to those oligomers that comprise at least one CpG, TpG or CpA dinucleotide.

The present invention encompasses, for each of SEQ ID NOS:1 to SEQ ID NO3, SEQ ID NO:24, SEQ ID NO:28, SEQ ID NOS:159 to SEQ ID NO:167, SEQ ID NOS:10 to SEQ ID NO:15, SEQ ID NOS: 28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequences selected from the group consisting of SEQ ID NOS:1 to SEQ ID NO:3, SEQ ID NO:24, SEQ ID NO:28, SEQ ID NOS:159 to SEQ ID NO:167. Preferred sets of such oligonucleotides or modified oligonucleotides of length X are those consecutively overlapping sets of oligomers corresponding to SEQ ID NOS:1 to SEQ ID NO:3, SEQ ID NO:24, SEQ ID NO:28, SEQ ID NOS:159 to SEQ ID NO:167, SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NO:168 to SEQ ID NO:203 (and to the complements thereof). Preferably, said oligomers comprise at least one CpG, TpG or CpA dinucleotide.

Particularly preferred oligonucleotides or oligomers according to the present invention are those in which the cytosine of the CpG dinucleotide (or of the corresponding converted TpG or CpA dinculeotide) sequences is within the middle third of the oligonucleotide; that is, where the oligonucleotide is, for example, 13 bases in length, the CpG, TpG or CpA dinucleotide is positioned within the fifth to ninth nucleotide from the 5'-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophors, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514, 758, 5,565,552, 5,567,810, 5,574,142, 5,585,481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., *BioTechniques* 6:958-976, 1988) or intercalating agents (Zon, *Pharm. Res.* 5:539-549, 1988). To this end, the oligonucleotide may be conjugated to another molecule, e.g., a chromophore, fluorophor, peptide, hybridization-triggered cross-linking agent, transport agent, hybridization-triggered cleavage agent, etc.

The oligonucleotide may also comprise at least one art-recognized modified sugar and/or base moiety, or may comprise a modified backbone or non-natural internucleoside linkage.

The oligonucleotides or oligomers according to particular embodiments of the present invention are typically used in 'sets,' which contain at least one oligomer for analysis of each of the CpG dinucleotides of a genomic sequence selected from the group consisting SEQ ID NOS:1 to SEQ ID NO:3, SEQ ID NO:24, SEQ ID NO:28, SEQ ID NOS:159 to SEQ ID NO:167 and sequences complementary thereto, or to the corresponding CpG, TpG or CpA dinucleotide within a sequence of the treated nucleic acids according to SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 and sequences complementary thereto. However, it is anticipated that for economic or other factors it may be preferable to analyse a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state in treated genomic DNA (SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203), or in genomic DNA (SEQ ID NOS:1 to SEQ ID NO:3, SEQ ID NO:24, SEQ ID NO:28, SEQ ID NO:159 to SEQ ID NO:167 and sequence complementary thereto). These probes enable diagnosis, classification and/or therapy of genetic and epigenetic parameters of liver and/or colorectal cell proliferative disorders. The set of oligomers may also be used for detecting single nucleotide polymorphisms (SNPs) in treated genomic DNA (SEQ ID NOS:10 to SEQ ID NO:15 SEQ ID NOS:28 to SEQ ID NO:33, SEQ ID NOS:30 to SEQ ID NO:31, SEQ ID NO:4 to SEQ ID NO:43, SEQ ID NO:38 to SEQ ID NO:39, SEQ ID NOS:50 to SEQ ID NO:51 SEQ ID NOS:168 to SEQ ID NO:203), or in genomic DNA (SEQ ID NOS:1 to SEQ ID NO:3, SEQ ID NO:24, SEQ ID NO:28, SEQ ID NO:159 to SEQ ID NOS:167 and sequences complementary thereto).

In preferred embodiments, at least one, and more preferably all members of set of oligonucleotides is bound to a solid phase.

In further embodiments, the present invention provides a set of at least two (2) oligonucleotides that are used as 'primer' oligonucleotides for amplifying DNA sequences of one of SEQ ID NOS:1 to SEQ ID NO:3, SEQ ID NO:24, SEQ ID NO:28 SEQ ID NOS:159 to SEQ ID NO:167, SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS: 50 to SEQ ID NO:51, SEQ ID NOS:168 to SEQ ID NO:203 and sequences complementary thereto, or segment thereof.

It is anticipated that the oligonucleotides may constitute all or part of an "array" of "DNA chip" (i.e., an arrangement of different oligonucleotides and/or PNA-oligomer bound to a solid phase). Such an array of different oligonucleotide- and/or PNA oligomer sequences can be characterized, for example, in that it is arranged on the solid phase in the form of a rectangular or hexagonal lattice. The solid-phase surface may be composed of silicon, glass, polystyrene, aluminium, steel, iron, copper, nickel silver, or gold. Nitrocellulose as well as plastics such as nylon, which can exist in the form of pellets or also as resin matrices, may also be used. An overview of the Prior A in oligomer array manufacturing can be gathered from a special edition of Nature Genetics (*Nature Genetics Supplement*, Volume 21, January 1999, and from the literature cited therein). Fluorescently labelled probes are often used for the scanning of immobilized DNA arrays. The simple attachment of Cy3 and Cy5 dyes to the 5'-O of the specific probe are particularly suitable for fluorescence labels. The detection the fluorescence of the hybridised probes may be carried out, for example, via confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S. Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

It is particularly preferred that the oligomers according to the invention are utilised for at least one of: detection of; detection and differentiation between or among subclasses of; diagnosis of; prognosis of; treatment of; monitoring of; and treatment and monitoring of liver and/or colorectal cell proliferative disorders. This is enabled by use of said sets for the detection or detection and differentiation of one or more of the following classes of tissues: colorectal carcinoma, colon adenoma, inflammatory colon tissue, grade 2 dysplasia colon adenomas less than 1 cm, grade 3 dysplasia colon adenomas larger than 1 cm, normal colon tissue, non-colon healthy tissue and non-colon cancer tissue.

Particularly preferred are those sets of oligomers according to the Examples.

In the most preferred embodiment of the method, the presence or absence of a cellular proliferative disorder, most preferably a neoplastic cellular proliferation or differentiation thereof from benign disorders is determined. This is achieved by analysis of the methylation status of at least one target sequence comprising at least one CpG position said sequence comprising, or hybridizing under stringent conditions to at least 16 contiguous nucleotides of a sequence selected from the group consisting SEQ ID NOS:1 to SEQ ID NO:3, SEQ ID NO:24, SEQ ID NO:28, SEQ ID NOS:159 to SEQ ID NO:167 and complements thereof. The present invention further provides a method for ascertaining genetic and/or epigenetic parameters of the genomic sequence according to SEQ ID NOS:1 to SEQ ID NO:3, SEQ ID NO:24, SEQ ID NO:28, SEQ ID NOS:159 to SEQ ID NO:167 within a subject by analysing cytosine methylation and single nucleotide polymorphisms. Said method comprising contacting a nucleic acid comprising SEQ ID NOS:1 to SEQ ID NO:3, SEQ ID NO:24, SEQ ID NO:28, SEQ ID NOS:159 to SEQ ID NO:167 in a biological sample obtained from said subject with at least one reagent or a series of reagents, wherein said reagent or series of reagents, distinguishes between methylated and non-methylated CpG dinucleotides within the target nucleic acid.

In a preferred embodiment, said method comprises the following steps: In the first step, a sample of the tissue to be analysed is obtained. The source may be any suitable source, such as cell lines, histological slides, biopsies, paraffin-embedded tissue, body fluids, stool, colonic effluent, urine, blood plasma, blood serum, whole blood, isolated blood cells, cells isolated from the blood and all possible combinations thereof. It is preferred that said sources of DNA are stool or body fluids selected from the group consisting colonic effluent, urine, blood plasma, blood serum, whole blood, isolated blood cells, cells isolated from the blood.

The genomic DNA is then isolated from the sample. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Wherein the sample DNA is not enclosed in a membrane (e.g. circulating DNA from a blood sample) methods standard in the art for the isolation and/or purification of DNA may be employed. Such methods include the use of a protein degenerating reagent e.g., chaotropic salt e.g. guanidine hydrochloride or urea; or a detergent e.g. sodium dodecyl sulphate (SDS), cyanogen bromide. Alternative methods include but are not limited to ethanol precipitation or propanol precipitation, vacuum concentration amongst others by means of a centrifuge. The person skilled in the art may also make use of devices such as filter devices, e.g., ultrafiltration, silica surfaces or membranes, magnetic particles, polystyrol particles, polystyrol surfaces, positively charged surfaces, and positively charged membranes, charged membranes, charged surfaces, charged switch membranes, charged switched surfaces.

Once the nucleic acids have been extracted, the genomic double stranded DNA is used in the analysis.

In the second step of the method, the genomic DNA sample is treated in such a manner that cytosine bases which are unmethylated at the 5'-position are converted to uracil, thymine, or another base which is dissimilar to cytosine in terms of hybridisation behaviour. This will be understood as 'pretreatment' or 'treatment' herein.

This is preferably achieved by means of treatment with a bisulfite reagent. The term "bisulfite reagent" refers to a reagent comprising bisulfite, disulfite, hydrogen sulfite or combinations thereof, useful as disclosed herein to distinguish between methylated and unmethylated CpG dinucleotide sequences. Methods of said treatment are known in the art (e.g., PCT/EP2004/011715, which is incorporated by reference in its entirety). It is preferred that the bisulfite treatment is conducted in the presence of denaturing solvents such as but not limited to n-alkylenglycol, particularly diethylene glycol dimethyl ether (DME), or in the presence of dioxane or dioxane derivatives. In a preferred embodiment the denaturing solvents are used in concentrations between 1% and 35% (v/v). It is also preferred that the bisulfite reaction is carried out in the presence of scavengers such as but not limited to chromane derivatives, e.g., 6-hydroxy-2,5,7,8, -tetramethylchromane 2-carboxylic acid or trihydroxybenzoe acid and derivates thereof, e.g., Gallic acid (see: PCT/EP2004/011715 which is incorporated by reference in its entirety). The bisulfite conversion is preferably carried out at a reaction temperature between 30° C. and 70° C., whereby the temperature is increased to over 85° C. for short periods of times during the reaction (see: PCT/EP2004/011715 which is incorporated by reference in its entirety). The bisulfite treated DNA is preferably purified priori to the quantification. This may be conducted by any means known in the art, such as but not limited to ultrafiltration, preferably carried out by means of Microcon^(™) columns (manufactured by Millipore^(™)). The purification is carried out according to a modified manufacturer's protocol (see: PCT/EP2004/011715 which is incorporated by reference in its entirety).

In the third step of the method, fragments of the treated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). Preferably said amplificates are 100 to 2,000 base pairs in length. The set of primer oligonucleotides includes at least two oligonucleotides whose sequences are each reverse complementary, identical, or hybridise under stringent or highly stringent conditions to an at least 16-base-pair long segment of the base sequences of one of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOs:38 to SEQ ID NO:39, SEQ ID NOS:50 to SEQ ID NO:51, SEQ ID NOS: 168 to SEQ ID NO:203 and sequences complementary thereto.

In an alternate embodiment of the method, the methylation status of pre-selected CpG positions within at least one nucleic acid sequences selected from the group consisting SEQ ID NOS:1 to SEQ ID NO:3, SEQ ID NO:24, SEQ ID NO:28, SEQ ID NOS:159 to SEQ ID NO:167 may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridises to a bisulfite treated CpG dinucleotide. Therefore, the sequence of said primers comprises at least one CpG dinucleotide. MSP primers specific for non-methylated DNA contain a "T" at the position of the C position in the CpG. Preferably, therefore, the base sequence of said primers is required to comprise a sequence having a length of at least 9 nucleotides which hybridises to a treated nucleic acid sequence according to one of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 and sequences complementary thereto, wherein the base sequence of said oligomers comprises at least one CpG dinucleotide. A further preferred embodiment of the method comprises the use of blocker oligonucleotides (the HeavyMethyl™ assay). The use of such blocker oligonucleotides has been described by Yu et al., *BioTechniques* 23:714-720, 1997. Blocking probe oligonucleotides are hybridised to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivitized at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having for example, thioate bridges at the 5'-terminii thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocked oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA oligomers as blocking oligonucleotides. Such PNA blocker oligomers are ideally suited because they are neither decomposed nor extended by the polymerase.

Preferably, therefore, the base sequence of said blocking oligonucleotides is required to comprise a sequence having a length of at least 9 nucleotides which hybridises to a treated nucleic acid sequence according to one of SEQ ID NOS:10 to SEQ ID NO:15, SEQ ID NOS:28 to SEQ ID NO:33, SEQ ID NOS:30 to SEQ ID NO:31 SEQ ID NOS:42 to SEQ ID NO:43, SEQ ID NOS:38 to SEQ ID NO:39, SEQ ID NOS:50 to SEQ ID NO:51, SEQ ID NOs:168 to SEQ ID NO:203 and sequences complementary thereto, wherein the base sequence of said oligonucleotides comprises at least one CpG, TpG or CpA dinucleotide.

The fragments obtained by means of the amplification can carry a directly or indirectly detectable label. Preferred are labels in the form of fluorescence labels radionuclides, or detachable molecule fragments having a typical mass which can be detected in a mass spectrometer. Where said labels are mass labels, it is preferred that the labelled amplificates have a single positive or negative net charge, allowing for better delectability in the mass spectrometer. The detection may be carried out and visualized by means of, e.g., matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas & Hillenkamp, *Anal Chem.*, 60:2299-301, 1988). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut & Beck, *Current Innovations and Future Trends*, 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallisation. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut & Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fourth step of the method, the amplificates obtained during the third step of the method are analysed in order to ascertain the methylation status of the CpG dinucleotides prior to the treatment.

In embodiments where the amplificates were obtained by means of MSP amplification, the presence or absence of an amplificate is in itself indicative of the methylation state of the CpG positions covered by the primer, according to the base sequences of said primer.

Amplificates obtained by means of both standard and methylation specific PCR may be further analysed by means of based-based methods such as, but not limited to, array technology and probe based technologies as well as by means of techniques such as sequencing and template directed extension.

In one embodiment of the method, the amplificates synthesised in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide. The hybridizing portion of the hybridizing nucleic acids is typically at least 9, 15, 20, 25, 30 or 35 nucleotides in length. However, longer molecules have inventive utility, and are thus within the scope of the present invention.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within a sequence selected from the group consisting SEQ ID NOS:1 to SEQ ID NO:3, SEQ ID NO:24, SEQ ID NO:28, SEQ ID NOS:159 to SEQ ID NO:167, and the equivalent positions within SEQ ID NOS:10 to SEQ ID NO:15, SEQ ID NOS:28 to SEQ ID NO:33, SEQ ID NOs:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203.

Said oligonucleotides may also be present in the form of peptide nucleic acids. The non-hybridised amplificates are then removed. The hybridised amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes (as detailed above) that are hybridised to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labelled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a non-extendible interrogating oligonucleotide, called a TaqMan™ probe, which, in preferred embodiments, is designed to hybridise to a CpG-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethyLight™™ assay. Variations on the TaqMan™ detection methodology that are also suitable for use with the described invention include the use of dual-probe technology (Lightcycler™) or fluorescent amplification primers (Sunrise™ technology). Both these techniques may be adapted in a manner suitable for use with bisulfite treated DNA, and moreover for methylation analysis within CpG dinucleotides.

In a further preferred embodiment of the method, the fourth step of the method comprises the use of template-directed oligonucleotide extension, such as MS-SNuPE as described by Gonzalgo & Jones, *Nucleic Acids Res.* 25:2529-2531, 1997.

In yet a further embodiment of the method, the fourth step of the method comprises sequencing and subsequent sequence analysis of the amplificate generated in the third step of the method (Sanger F., et al., *Proc Natl Acad Sci USA* 74:5463-5467, 1977).

Best Mode

In the most preferred embodiment of the method the genomic nucleic acids are isolated and treated according to the first three steps of the method outlined above, namely:
  a) obtaining, from a subject, a biological sample having subject genomic DNA;
  b) extracting or otherwise isolating the genomic DNA;
  c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein
  d) amplifying subsequent to treatment in c) is carried out in a methylation specific manner, namely by use of methylation specific primers or blocking oligonucleotides, and further wherein
  e) detecting of the amplificates is carried out by means of a real-time detection probe, as described above.

Preferably, where the subsequent amplification of d) is carried out by means of methylation specific primers, as described above, said methylation specific primers comprise a sequence having a length of at least 9 nucleotides which hybridises to a treated nucleic acid sequence according to one of SEQ ID NOS:10 to SEQ ID NO:15, SEQ ID NOS:28 to SEQ ID NO:33, SEQ ID NOS:30 to SEQ ID NO:31, SEQ ID NS:42 to SEQ ID NO:43, SEQ ID NOS:38 to SEQ ID NO:39, SEQ ID NOS:50 to SEQ ID NO:51, SEQ ID NOs:168 to SEQ ID NO:203 and sequences complementary thereto, wherein the base sequence of said oligomers comprise at least one CpG dinucleotide.

Step e) of the method, namely the detection of the specific amplificates indicative of the methylation status of one or more CpG positions of at least one sequences of the group comprising SEQ ID NOS:1 to SEQ ID NO:3, SEQ ID NO:24, SEQ ID NO:28, SEQ ID NOS:159 to SEQ ID NO:167 is carried out by means of real-time detection methods as described above.

Additional embodiments of the invention provide a method for the analysis of the methylation status of genomic DNA according to the invention (SEQ ID NOs:1 to SEQ ID NO:3, SEQ ID NO:24, SEQ ID NO:28, SEQ ID NOS:159 to SEQ ID NO:167, and complements thereof) without the need for bisulfite conversion. Methods are known in the art wherein a methylation sensitive restriction enzyme reagent, or a series of restriction enzyme reagents comprising methylation sensitive restriction enzyme reagents that distinguishes between methylated and non-methylated CpG dinucleotides within a target region are utilized in determining methylation, for example but not limited to DMH.

In the first step of such additional embodiments, the genomic DNA sample is isolated from tissue or cellular sources. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants, e.g., by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA. All clinical sample types comprising neoplastic or potentially neoplastic matter are suitable for use in the present method, preferred are cell lines, histological slides, biopsies, paraffin-embedded tissue, body fluids, stool, colonic effluent, urine, blood plasma, blood serum, whole blood, isolated blood cells, cells isolated from the blood and combinations thereof. Body fluids are the preferred source of the DNA; particularly preferred are blood plasma, blood serum, whole blood, isolated blood cells and cells isolated from the blood.

Once the nucleic acids have been extracted, the genomic double-stranded DNA is used in the analysis.

In a preferred embodiment, the DNA may be cleaved prior to treatment with methylation sensitive restriction enzymes. Such methods are known in the art and may include both physical and enzymatic means. Particularly preferred is the use of one or a plurality of restriction enzymes which are not methylation sensitive, and whose recognition sites are AT rich and do not comprise CG dinucleotides. The use of such enzymes enables the conservation of CpG islands and CpG rich regions in the fragmented DNA. The non-methylation-specific restriction enzymes are preferably selected from the group consisting of MseI, BfaI, Csp6I, Tru1I, Tvu1I, Tru9I, Tvu9I, MaeI and XspI. Particularly preferred is the use of two or three such enzymes. Particularly preferred is the use of a combination of MseI, BfaI and Csp6I.

The fragmented DNA may then be ligated to adaptor oligonucleotides in order to facilitate subsequent enzymatic amplification. The ligation of oligonucleotides to blunt and sticky ended DNA fragments is known in the art, and is carried out by means of dephosphorylation of the ends (e.g. using calf or shrimp alkaline phosphatase) and subsequent ligation using ligase enzymes (e.g. T4 DNA ligase) in the presence of dATPs. The adaptor oligonucleotides are typically at least 18 base pairs in length.

In the third step, the DNA (or fragments thereof) is then digested with one or more methylation sensitive restriction enzymes. The digestion is carried out such that hydrolysis of the DNA at the restriction site is informative of the methylation status of a specific CpG dinucleotide of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165.

Preferably, the methylation-specific restriction enzyme is selected from the group consisting of Bsi E1, Hga I HinPI, Hpy99I, Ava I, Bce AI, Bsa HI, BisI, BstUI, Bshl236I, AccII, BstFNI, McrBC, GlaI, MvnI, HpaII (HapII), HhaI, AciI, SmaI, HinP1I, HpyCH4IV, EagI and mixtures of two or more of the above enzymes. Preferred is a mixture containing the restriction enzymes BstUI, HpaII, HpyCH4IV and HinP1l.

In the fourth step, which is optional but a preferred embodiment, the restriction fragments are amplified. This is preferably carried out using a polymerase chain reaction, and said amplificates may carry suitable detectable labels as discussed above, namely fluorophore labels, radionuclides and mass labels. Particularly preferred is amplification by means of an amplification enzyme and at least two primers comprising, in each case a contiguous sequence at least 16 nucleotides in length that is complementary to, or hybridizes under moderately stringent or stringent conditions to a sequence selected from the group consisting SEQ ID NOS:1 to SEQ ID NO:3, SEQ ID NO:24, SEQ ID NO:28, SEQ ID NOS:159 to SEQ ID NO:167, and complements thereof. Preferably said contiguous sequence is at least 16, 20 or 25 nucleotides in length. In an alternative embodiment said primers may be complementary to any adaptors linked to the fragments.

In the fifth step the amplificates are detected. The detection may be by any means standard in the art, for example, but not limited to, gel electrophoresis analysis, hybridisation analysis, incorporation of detectable tags within the PCR products, DNA array analysis, MALDI or ESI analysis. Preferably said detection is carried out by hybridisation to at least one nucleic acid or peptide nucleic acid comprising in each case a contiguous sequence at least 16 nucleotides in length that is complementary to, or hybridizes under moderately stringent or stringent conditions to a sequence selected from the group consisting SEQ ID NOS:1 to SEQ ID NO:3, SEQ ID NO:24, SEQ ID NO:28, SEQ ID NOS:159 to SEQ ID NO:167, and complements thereof. Preferably said contiguous sequence is at least 16, 20 or 25 nucleotides in length.

Subsequent to the determination of the methylation state or level of the genomic nucleic acids the presence, absence or class of cellular proliferative disorder is deduced based upon the methylation state or level of at least one CpG dinucleotide sequence of at least one sequence selected from the group consisting SEQ ID NOS:1 to SEQ ID NO:3, SEQ ID NO:24, SEQ ID NO:28, SEQ ID NOS:159 to SEQ ID NO:167, or an average, or a value reflecting an average methylation state of a plurality of CpG dinucleotide sequences of at least one sequence selected from the group consisting SEQ ID NOS:1 to SEQ ID NO:3, SEQ ID NO:24, SEQ ID NO:28, SEQ ID NOS:159 to SEQ ID NO:167 wherein methylation is associated with a neoplastic or pre-neoplastic cellular proliferative disorder. Wherein said methylation is determined by quantitative means the cut-off point for determining said the presence of methylation is preferably zero (i.e. wherein a sample displays any degree of methylation it is determined as having a methylated status at the analysed CpG position). Nonetheless, it is foreseen that the person skilled in the art may wish to adjust said cut-off value in order to provide an assay of a particularly preferred sensitivity or specificity. Accordingly said cut-off value may be increased (thus increasing the specificity), said cut off value may be within a range selected form the group consisting of 0%-5%, 5%-10%, 10%-15%, 15%-20%, 20%-30% and 30%-50%. Particularly preferred are the cut-offs 10%, 15%, 25%, and 30%.

In an alternative embodiment of the method wherein a panel of genes comprising the Septin 9 or its truncated transcript Q9HC74 and at least one gene selected from the group consisting FOXL2, NGFR, TMEFF2, SIX6, SARM1, VTN and ZDHHC22 subsequent to the determination of the methylation state of the genomic nucleic acids the presence, absence or subclass of cellular proliferative disorders, in particular liver and/or colorectal cell proliferative disorder is deduced based upon the methylation state of at least one CpG dinucleotide sequence of SEQ ID NO:1 and at least one CpG dinucleotide sequence of SEQ ID NO:24 to SEQ ID NO:29, or an average, or a value reflecting an average methylation state of a plurality of CpG dinucleotide sequences thereof wherein hypermethylation is associated with cancers, in particular liver and/or colorectal cancer.

Diagnostic and Prognostic Assays for Cellular Proliferative Disorders

The present invention enables diagnosis of events which are disadvantageous to patients or individuals in which important genetic and/or epigenetic parameters within at least one gene or genomic sequence selected from the group consisting of Septin 9 (including all transcript variants thereof, FOXL2, SARM1, VTN, PRDM6, NR2E1, FAT and SEQ ID NOS:160 to SEQ ID NO:165 may be used as markers. Said parameters obtained by means of the present invention may be compared to another set of genetic and/or epigenetic parameters, the differences serving as the basis for a diagnosis and/or prognosis of events which are disadvantageous to patients or individuals.

More specifically the present invention enables the screening of at-risk populations for the early detection of cancers, most preferably liver cancer and/or colorectal carcinomas. Furthermore, the present invention enables the differentiation of neoplastic (e.g. malignant) from benign (i.e. non-cancerous) cellular proliferative disorders. For example, it enables the differentiation of a colorectal carcinoma from small colon adenomas or polyps. Neoplastic cellular proliferative disorders present decreased methylation (i.e. decreased expression) within at least one gene or genomic sequence selected from the group consisting of Septin 9 (including all transcript variants thereof, FOXL2, SARM1, VTN, PRDM6, NR2E1, FAT and SEQ ID NOS:160 to SEQ ID NO:165, as opposed to said benign disorders which do not.

Specifically, the present invention provides for diagnostic and classification cancer assays based on measurement of differential expression (preferably methylation) of one or more CpG dinucleotide sequences of at least one sequence selected from the group consisting SEQ ID NOS:1 to SEQ ID NO:3, SEQ ID NO:24, SEQ ID NO:28, SEQ ID NOS:159 to SEQ ID NO:167 that comprise such a CpG dinucleotide sequence. Typically, such assays involve obtaining a sample from a subject, performing an assay to measure the expression of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165, preferably by determining the methylation status of at least one sequence selected from the group consisting SEQ ID NOS:1 to SEQ ID NO:3, SEQ ID NO:24, SEQ ID NO:28, SEQ ID NOS:159 to SEQ ID NO:167, derived from the sample, relative to a control sample, or a known standard and making a diagnosis based thereon.

In particular preferred embodiments, inventive oligomers are used to assess the CpG dinucleotide methylation status, such as those based on SEQ ID NOS:1 to SEQ ID NO:3, SEQ ID NO:24, SEQ ID NO:28, SEQ ID NOS:159 to SEQ ID NO:167, SEQ ID NOS:10 to SEQ ID NO:15, SEQ ID NOS: 28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203, or arrays thereof, as well as in kits based thereon and useful for the diagnosis and/or classification of cellular proliferative disorders.

Kits

Moreover, an additional aspect of the present invention is a kit comprising: a means for determining methylation of at least one gene or genomic sequence selected from the group consisting of Septin 9 (including all transcript variants thereof, FOXL2, SARM1, VTN, PRDM6, NR2E1, FAT and SEQ ID NOS:160 to SEQ ID NO:165. The means for determining methylation comprise preferably a bisulfite-containing reagent; one or a plurality of oligonucleotides consisting whose sequences in each case are identical, are complementary, or hybridise under stringent or highly stringent conditions to a 9 or more preferably 18 base long segment of a sequence selected from SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203; and optionally instructions for carrying out and evaluating the described method of methylation analysis. In one embodiment the base sequence of said oligonucleotides comprises at least one CpG, CpA or TpG dinucleotide.

In a further embodiment, said kit may further comprise standard reagents for performing a CpG position-specific methylation analysis, wherein said analysis comprises one or more of the following techniques: MS-SNuPE, MSP, MethyLight™, HeavyMethyl, COBRA, and nucleic acid sequencing. However, a kit along the lines of the present invention can also contain only part of the aforementioned components.

In a preferred embodiment the kit may comprise additional bisulfite conversion reagents selected from the group consisting: DNA denaturation buffer; sulfonation buffer; DNA recovery reagents or kits (e.g., precipitation, ultrafiltration, affinity column); desulfonation buffer; and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining a biological sample of the patient. Preferred is a kit, which further comprises a container suitable for containing the means for determining methylation of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165 in the biological sample of the patient, and most preferably further comprises instructions for use and interpretation of the kit results. In a preferred embodiment the kit comprises: (a) a bisulfite reagent; (b) a container suitable for containing the said bisulfite reagent and the biological sample of the patient; (c) at least one set of primer oligonucleotides containing two oligonucleotides whose sequences in each case are identical, are complementary, or hybridise under stringent or highly stringent conditions to a 9 or more preferably 18 base long segment of a sequence selected from SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS: 50 to SEQ ID NO:51, SEQ ID NOS:168 to SEQ ID NO:203; and optionally (d) instructions for use and interpretation of the kit results. In an alternative preferred embodiment the kit comprises: (a) a bisulfite reagent; (b) a container suitable for containing the said bisulfite reagent and the biological sample of the patient; (c) at least one oligonucleotides and/or PNA-oligomer having a length of at least 9 or 16 nucleotides which is identical to or hybridises to a pre-treated nucleic acid sequence according to one of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS: 50 to SEQ ID NO:51, SEQ ID NOS:168 to SEQ ID NO:203 and sequences complementary thereto; and optionally (d) instructions for use and interpretation of the kit results.

In an alternative embodiment the kit comprises: (a) a bisulfite reagent; (b) a container suitable for containing the said bisulfite reagent and the biological sample of the patient; (c) at least one set of primer oligonucleotides containing two oligonucleotides whose sequences in each case are identical, are complementary, or hybridise under stringent or highly stringent conditions to a 9 or more preferably 18 base long segment of a sequence selected from SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203; (d) at least one oligonucleotides and/or PNA-oligomer having a length of at least 9 or 16 nucleotides which is identical to or hybridises to a pre-treated nucleic acid sequence according to one of SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 and sequences complementary thereto; and optionally (e) instructions for use and interpretation of the kit results.

The kit may also contain other components such as buffers or solutions suitable for blocking, washing or coating, packaged in a separate container.

Typical reagents (e.g., as might be found in a typical COBRA™-based kit) for COBRA™ analysis may include, but are not limited to: PCR primers for at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165; restriction enzyme and appropriate buffer; gene-hybridization oligo; control hybridization oligo; kinase labeling kit for oligo probe; and labeled nucleotides. Typical reagents (e.g., as might be found in a typical MethyLight™-based kit) for MethyLight™ analysis may include, but are not limited to: PCR primers for the bisulfite converted sequence of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165; bisulfite specific probes (e.g., TaqMan™ or Lightcycler™); optimized PCR buffers and deoxynucleotides; and Taq polymerase.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for the bisulfite converted sequence of at least one gene or genomic sequence selected from the group consisting of Septin 9 (including all transcript variants thereof), FOXL2, SARM1, VTN, PRDM6, NR2E1, FAT and SEQ ID NOS:160 to SEQ ID NO:165; reaction buffer (for the Ms-SNuPE reaction); and labelled nucleotides.

Typical reagents (e.g., as might be found in a typical MSP-based kit) for MSP analysis may include, but are not limited to: methylated and unmethylated PCR primers for the bisulfite converted sequence of or genomic sequence selected from the group consisting of Septin 9 (including all transcript variants thereof, FOXL2, SARM1, VTN, PRDM6, NR2E1, FAT and SEQ ID NOS:160 to SEQ ID NO:165, optimized PCR buffers and deoxynucleotides, and specific probes.

Moreover, an additional aspect of the present invention is an alternative kit comprising a means for determining methylation of at least one gene or genomic sequence selected from the group consisting of Septin 9 (including all transcript variants thereof), FOXL2, SARM1, VTN, PRDM6, NR2μl, FAT and SEQ ID NOS:160 to SEQ ID NO:165, wherein said means comprise preferably at least one methylation specific restriction enzyme; one or a plurality of primer oligonucleotides (preferably one or a plurality of primer pairs) suitable for the amplification of a sequence comprising at least one CpG dinucleotide of a sequence selected from SEQ ID NO:1 to SEQ ID NO:3, SEQ ID NO:24, SEQ ID NO:28, SEQ ID NOS:159 to SEQ ID NO:167; and optionally instructions for carrying out and evaluating the described method of methylation analysis. In one embodiment the base sequence of said oligonucleotides are identical, are complementary, or hybridise under stringent or highly stringent conditions to an at least 18 base long segment of a sequence selected from SEQ ID NOS:1 to SEQ ID NO:3, SEQ ID NO:24, SEQ ID NO:28, SEQ ID NOS:159 to SEQ ID NO:167.

In a further embodiment said kit may comprise one or a plurality of oligonucleotide probes for the analysis of the digest fragments, preferably said oligonucleotides are identical, are complementary, or hybridise under stringent or highly stringent conditions to an at least 16 base long segment of a sequence selected from SEQ ID NOS:1 to SEQ ID NO:3, SEQ ID NO:24, SEQ ID NO:28, SEQ ID NOS:159 to SEQ ID NO:167.

In a preferred embodiment the kit may comprise additional reagents selected from the group consisting: buffer (e.g., restriction enzyme, PCR, storage or washing buffers); DNA recovery reagents or kits (e.g., precipitation, ultrafiltration, affinity column) and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining a biological sample of the patient. In a preferred embodiment the kit comprises: (a) a methylation sensitive restriction enzyme reagent; (b) a container suitable for containing the said reagent and the biological sample of the patient; (c) at least one set of oligonucleotides one or a plurality of nucleic acids or peptide nucleic acids which are identical, are complementary, or hybridise under stringent or highly stringent conditions to an at least 9 base long segment of a sequence selected from SEQ ID NOS:1 to SEQ ID NO:3, SEQ ID NO:24, SEQ ID NO:28, SEQ ID NOS:159 to SEQ ID NO:167; and optionally (d) instructions for use and interpretation of the kit results.

In an alternative preferred embodiment the kit comprises: (a) a methylation sensitive restriction enzyme reagent; (b) a container suitable for containing the said reagent and the biological sample of the patient; (c) at least one set of primer oligonucleotides suitable for the amplification of a sequence comprising at least one CpG dinucleotide of a sequence selected from SEQ ID NOs:1 to SEQ ID NO:3, SEQ ID NO:24, SEQ ID NO:28, SEQ ID NOS:159 to SEQ ID NO:167; and optionally (d) instructions for use and interpretation of the kit results.

In an alternative embodiment the kit comprises: (a) a methylation sensitive restriction enzyme reagent; (b) a container suitable for containing the said reagent and the biological sample of the patient; (c) at least one set of primer oligonucleotides suitable for the amplification of a sequence comprising at least one CpG dinucleotide of a sequence selected from SEQ ID NOS:1 to SEQ ID NO:3, SEQ ID NO:24, SEQ ID NO:28, SEQ ID NOS:159 to SEQ ID NO:167; (d) at least one set of oligonucleotides one or a plurality of nucleic acids or peptide nucleic acids which are identical, are complementary, or hybridise under stringent or highly stringent conditions to an at least 9 base long segment of a sequence selected from SEQ ID NOS:1 to SEQ ID NO:3, SEQ ID NO:24, SEQ ID NO:28, SEQ ID NOS:159 to SEQ ID NO:167 and optionally (e) instructions for use and interpretation of the kit results.

The kit may also contain other components such as buffers or solutions suitable for blocking, washing or coating, packaged in a separate container.

The invention further relates to a kit for use in providing a diagnosis of the presence of a cell proliferative disorder in a subject by means of methylation-sensitive restriction enzyme analysis. Said kit comprises a container and a DNA microarray component. Said DNA microarray component being a surface upon which a plurality of oligonucleotides are immobilized at designated positions and wherein the oligonucleotide comprises at least one CpG methylation site. At least one of said oligonucleotides is specific for the at least one gene or genomic sequence selected from the group consisting of Septin 9 (including all transcript variants thereof, FOXL2, SARM1, VTN, PRDM6, NR2E1, FAT and SEQ ID NOS:160 to SEQ ID NO:165 and comprises a sequence of at least 15 base pairs in length but no more than 200 bp of a sequence according to one of SEQ ID NOS:1 to SEQ ID NO:3, SEQ ID NO:24, SEQ ID NO:28, SEQ ID NOS:159 to SEQ ID NO:167. Preferably said sequence is at least 15 base pairs in length but no more than 80 bp of a sequence according to one of SEQ ID NOS:1 to SEQ ID NO:3, SEQ ID NO:24, SEQ ID NO:28, SEQ ID NOS:159 to SEQ ID NO:167. It is further preferred that said sequence is at least 20 base pairs in length but no more than 30 bp of a sequence according to one of SEQ ID NOs:1 to SEQ ID NO:3, SEQ ID NO:24, SEQ ID NO:28, SEQ ID NOS:159 to SEQ ID NO:167.

Said test kit preferably further comprises a restriction enzyme component comprising one or a plurality of methylation-sensitive restriction enzymes.

In a further embodiment said test kit is further characterized in that it comprises at least one methylation-specific restriction enzyme, and wherein the oligonucleotides comprise a restriction site of said at least one methylation specific restriction enzymes.

The kit may further comprise one or several of the following components, which are known in the art for DNA enrichment: a protein component, said protein binding selectively to methylated DNA; a triplex-forming nucleic acid component, one or a plurality of linkers, optionally in a suitable solution; substances or solutions for performing a ligation e.g. ligases, buffers; substances or solutions for performing a column chromatography; substances or solutions for performing an immunology based enrichment (e.g. immunoprecipitation); substances or solutions for performing a nucleic acid amplification e.g. PCR; a dye or several dyes, if applicable with a coupling reagent, if applicable in a solution; substances or solutions for performing a hybridization; and/or substances or solutions for performing a washing step.

The described invention further provides a composition of matter useful for detecting, differentiation and distinguishing between colon cell proliferative disorders. Said composition comprising at least one nucleic acid 18 base pairs in length of a segment of the nucleic acid sequence disclosed in SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203, and one or more substances taken from the group comprising: 1-5 mM Magnesium Chloride, 100-500 µM dNTP, 0.5-5 units of taq polymerase, bovine serum albumen, an oligomer in particular an oligonucleotide or peptide nucleic acid (PNA)-oligomer, said oligomer comprising in each case at least one base sequence having a length of at least 9 nucleotides which is complementary to, or hybridizes under moderately stringent or stringent conditions to a pretreated genomic DNA according to one of the SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203 and sequences complementary thereto. It is preferred that said composition of matter comprises a buffer solution appropriate for the stabilization of said nucleic acid in an aqueous solution and enabling polymerase based reactions within said solution. Suitable buffers are known in the art and commercially available.

In further preferred embodiments of the invention said at least one nucleic acid is at least 50, 100, 150, 200, 250 or 500 base pairs in length of a segment of the nucleic acid sequence disclosed in SEQ ID NOS:10 to SEQ ID NO:15, SEQ ID NOS:28 to SEQ ID NO:33, SEQ ID NOS:30 to SEQ ID NO:31, SEQ ID NOS:42 to SEQ ID NO:43, SEQ ID NOS:38 to SEQ ID NO:39, SEQ ID NOS:50 to SEQ ID NO:51, SEQ ID NOS:168 to SEQ ID NO:203.

While the present invention has been described with specificity in accordance with certain of its preferred embodiments, the following examples serve only to illustrate the invention and are not intended to limit the invention within the principles and scope of the broadest interpretations and equivalent configurations thereof.

EXAMPLES

Example 1

In the following example the sequences listed below were analysed by means of MSP and/or HeavyMethyl assay. The assays are designed to be run on the LightCycler platform (Roche Diagnostics), but other such instruments commonly used in the art are also suitable.

MSP amplificates are detected by means of Taqman style fluorescent labelled detection probes, HeavyMethyl amplificates are detected by means of Lightcycler style dual probes.

Genomic Region of Interest:
SEQ ID NO: 165
  Assay Type: HeavyMethyl
  Primers:
SEQ ID NO: 249
SEQ ID NO: 250
Blockers:
SEQ ID NO: 251
  Probes:
SEQ ID NO: 252
SEQ ID NO: 253
  Temperature Cycling Program:

| Activation: | 95° C. | 10 min | |
|---|---|---|---|
| 55 cycles: | 95° C. | 10 sec | (20° C./s) |
| | 56° C. | 30 sec | (20° C./s) |
| | 72° C. | 10 sec | (20° C./s) |
| Melting | 95° C. | 10 sec | 20 |
| | 35° C. | 20 sec | 20 detection |
| | 95° C. | 0 sec | 0.1 |

Genomic Region of Interest:
SEQ ID NO: 24
  Assay Type: HeavyMethyl
  Primers:
SEQ ID NO: 254
SEQ ID NO: 255
  Blockers:
SEQ ID NO: 256
  Probes:
SEQ ID NO: 257 (fluo labelled)
SEQ ID NO: 258 (Red640 labelled)
  Temperature Cycling Program:

| Denaturation at 95° C. | 95° C. | 10 min | |
|---|---|---|---|
| 55 cycles: | | | |
| Denaturation at | 95° C. | 10 sec | (20° C./s) |
| Annealing | 56° C. | 30 sec | (20° C./s) |
| Extension | 72° C. | 10 sec | (20° C./s) |
| Melting | 95° C. | 10 sec | 20 |
| | 35° C. | 20 sec | 20 |
| | 95° C. | 0 sec | 0.1 |

Genomic Region of Interest:
SEQ ID NO: 24
  Assay Type: HeavyMethyl
  Primers:
SEQ ID NO: 264
SEQ ID NO: 265
  Blockers:
SEQ ID NO: 266
  Probes:
SEQ ID NO: 267 (fluo labelled)
SEQ ID NO: 268 (Red640 labelled)
  Temperature Cycling Program:

| Denaturation at 95° C. | 95° C. | 10 min | |
|---|---|---|---|
| 55 cycles: | | | |
| Denaturation at | 95° C. | 10 sec | (20° C./s) |
| Annealing | 56° C. | 30 sec | (20° C./s) |
| Extension | 72° C. | 10 sec | (20° C./s) |
| Melting | 95° C. | 10 sec | 20 |
| | 35° C. | 20 sec | 20 |
| | 95° C. | 0 sec | 0.1 |

Genomic Region of Interest:
SEQ ID NO: 28
  Assay Type: MSP
  Primers:
SEQ ID NO: 274
SEQ ID NO: 275
  Taqman Probes:
SEQ ID NO: 276
  Temperature Cycling Program:

| Activation: | 95° C. | 10 min |
|---|---|---|
| 55 cycles: | 95° C. | 15 sec (20° C./s) |
| | 62° C. | 45 sec (20° C./s) |
| Cooling: | 40° C. | 5 sec |

Genomic Region of Interest:
SEQ ID NO: 1
  Assay Type: MSP
  Primers:
SEQ ID NO: 277
SEQ ID NO: 278
  Taqman Probes:
SEQ ID NO: 279
  Temperature Cycling Program:

| Activation: | 95° C. | 10 min |
|---|---|---|
| 55 cycles: | 95° C. | 15 sec (20° C./s) |
| | 62° C. | 45 sec (20° C./s) |
| Cooling: | 40° C. | 5 sec |

Genomic Region of Interest:
SEQ ID NO: 28
  Assay Type: MSP
  Primers:
SEQ ID NO: 280
SEQ ID NO: 281
  Taqman Probes:
SEQ ID NO: 282
  Temperature Cycling Profile:

| Activation: | 95° C. | 10 min |
| 55 cycles: | 95° C. | 15 sec (20° C./s) |
|  | 62° C. | 45 sec (20° C./s) |

Genomic Region of Interest:
SEQ ID NO: 1
  Assay Type: MSP
  Primers:
SEQ ID NO: 283
SEQ ID NO: 284
  Taqman Probes:
SEQ ID NO: 285
  Temperature Cycling Profile:

| Activation: | 95° C. | 10 min |
| 55 cycles: | 95° C. | 15 sec (20° C./s) |
|  | 62° C. | 45 sec (20° C./s) |

Genomic Region of Interest:
SEQ ID NO: 28
  Assay Type: HeavyMethyl
  Primers:
SEQ ID NO: 286
SEQ ID NO: 287
  Blockers:
SEQ ID NO: 288
  Probes:
SEQ ID NO: 289
SEQ ID NO: 290
  Temperature Cycling Profile:

| Activation at 95° C. | 95° C. | 10 min | |
| 50 cycles: | | | |
| Denaturation at | 95° C. | 10 sec | (20° C./s) |
| Annealing | 56° C. | 30 sec | (20° C./s) |
| Extension | 72° C. | 10 sec | (20° C./s) |
| Melting | 95° C. | 10 sec | 20 |
|  | 40° C. | 10 sec | 20 |
|  | 70° C. | 0 sec | 0.1 |
| Cooling | 40° C. | 5 sec | |

Genomic Region of Interest:
SEQ ID NO: 1
  Assay Type: HeavyMethyl
  Primers:
SEQ ID NO: 291
SEQ ID NO: 292
  Blockers:
SEQ ID NO:293
  Probes:
SEQ ID NO: 294
SEQ ID NO: 295

Temperature Cycling Profile:

| Activation at 95° C. | 95° C. | 10 min | |
| 50 cycles: | | | |
| Denaturation at | 95° C. | 10 sec | (20° C./s) |
| Annealing | 56° C. | 30 sec | (20° C./s) |
| Extension | 72° C. | 10 sec | (20° C./s) |
| Melting | 95° C. | 10 sec | 20 |
|  | 40° C. | 10 sec | 20 |
|  | 70° C. | 0 sec | 0.1 |
| Cooling | 40° C. | 5 sec | |

Genomic Region of Interest:
SEQ ID NO: 1
  Assay Type: HeavyMethyl
  Primers:
SEQ ID NO: 296
SEQ ID NO: 297
  Blockers:
SEQ ID NO: 289
  Probes:
SEQ ID NO: 299
SEQ ID NO: 300
  Temperature Cycling Profile:

| Activation at 95° C. | 95° C. | 10 min | |
| 50 cycles: | | | |
| Denaturation at | 95° C. | 10 sec | (20° C./s) |
| Annealing | 56° C. | 30 sec | (20° C./s) |
| Extension | 72° C. | 10 sec | (20° C./s) |
| Melting | 95° C. | 10 sec | 20 |
|  | 40° C. | 10 sec | 20 |
|  | 70° C. | 0 sec | 0.1 |
| Cooling | 40° C. | 5 sec | |

Genomic Region of Interest:
SEQ ID NO: 166
  Assay Type: HeavyMethyl
  Primers:
SEQ ID NO: 259
SEQ ID NO: 260
  Blockers:
SEQ ID NO: 261
  Probes:
SEQ ID NO: 262
SEQ ID NO: 263
  Temperature Cycling Profile:

| Activation: | 95° C. | 10 min |
| 55 cycles: | 95° C. | 10 sec |
|  | 58° C. | 30 sec |
|  | 72° C. | 10 sec |
| Melting curve: | 95° C. | 10 sec |
|  | 35° C. | 20 sec |
|  | 95° C. | 0 sec |
| Cooling: | 40° C. | 5 sec |

Genomic Region of Interest:
SEQ ID NO: 167
  Assay Type: HeavyMethyl
  Primers:
SEQ ID NO: 269
SEQ ID NO: 270

Blockers:
SEQ ID NO: 271
Probes:
SEQ ID NO: 272
SEQ ID NO: 273
Temperature Cycling Profile:

| Denaturation at 95° C. 55 cycles: | 95° C. | 10 min |
|---|---|---|
| Denaturation at | 95° C. | 10 sec |
| Annealing | 56° C. | 30 sec |
| Extension | 72° C. | 10 sec |
| Melting | 95° C. | 10 sec |
|  | 40° C. | 10 sec |

Example 2

The following analysis was performed in order to select preferred panels suitable for colorectal carcinoma screening and/or diagnosis based on analysis of DNA methylation within whole blood.

The performance of each marker was analysed using an assay platform (Lightcycler) and real time assays (MSP and/or HeavyMethyl) as would be suitable for use in a reference or clinical laboratory setting. The performance of each marker was tested independently in colorectal carcinoma tissue and whole blood, in order to provide an indication of the accuracy of each marker.

The panels were selected from the group of markers consisting:
SEQ ID NO:376
SEQ ID NO:378
SEQ ID NO:27
SEQ ID NO:26
SEQ ID NO:24
SEQ ID NO:1
SEQ ID NO:165
SEQ ID NO:25
SEQ ID NO:28
SEQ ID NO:378
SEQ ID NO:163

Each marker was analysed by means of at least one methylation specific assay, namely MSP and/or HeavyMethyl, as shown in Table 2.

A further assay (not methylation specific), hereinafter referred to as the C3 assay was performed in order to quantify the total amount of DNA in each sample. The C3 assay is a bisulfite DNA assay that detects total DNA irrespective of methylation state. The following primers and probes were used:

```
Primer:
GGAGTGGAGGAAATTGAGAT            SEQ ID NO: 62

Primer:
CCACACAACAAATACTCAAAAC          SEQ ID NO: 63

Probe:
TGGGTGTTTGTAATTTTTGTTTTGTGTTAGGTT    SEQ ID NO: 64
```

Each assay was run in duplicate on colorectal carcinoma, normal adjacent tissue and/or whole blood samples as shown in Table 3.

DNA extraction was carried out using commercially available kits, and bisulfite conversion was carried out with minor modifications according to the method described in Olek et al. (1996).

All assays (C3 and methylation specific) were performed using the Lightcycler platform.

Data Interpretation

Calculation of DNA Concentration.

The Cp (crossing point values) and intensity curves as calculated by the Lightcycler instrument software were used to determine DNA concentration. The DNA concentration was calculated by reference of the CP value of each well to a standard curve for both the methylation assays and the C3 assay.

Sample Replicates

In most cases each assay was run twice per sample, resulting in multiple measurements per sample. For each sample a score is calculated as follows:
1. Calculate the ratio v1/v2 for all sample pairs
2. If both are below a threshold of 0.1 ng, the ratio is set to =, if one is = and the other is above threshold, set the ratio to 100
3. For each assay samples whose ratio exceeds 2.5 are not analysed further
4. For samples not having exactly two replicates the average is taken without taking any scores Percentage Methylation All samples that measured less than 1 ng DNA using the C3 assay were not further considered. For each sample the detected percentage methylation was calculated as the measured concentration of DNA quantified using the methylation assays over the concentration of DNA in the sample as quantified by the C3 assay.

Detection of methylation was determined at three different threshold levels, see tables) as well as at all methylation levels (i.e. any samples wherein methylation was detected were deemed positive).

The sensitivity of each assay was determined from the colorectal carcinoma sample positive detection rate, wherein sensitivity was determined as the % samples wherein methylation was positively detected (i.e. true positives).

The specificity of each assay was determined from the whole blood sample negative detection rate (i.e. true negative detection rate) wherein false positives were discounted from the total number of analysed samples.

Results

The proportion of the analysed samples with methylation measured within various thresholds by individual assays are shown in Tables 4 (colorectal carcinoma tissue), 5 (normal adjacent tissue) and 6 (whole blood).

FIGS. 30 to 37 show the binary distribution plot (upper left hand side of the figure) and where relevant multiclass distribution plot (lower left hand side of the figure) of the proportion (Y-axis) of colorectal carcinoma tissue and whole blood, (and in some cases normal adjacent tissues) samples with a measured methylation level above a specified cut-off point (X-axis). On the right hand side of each figure is a ROC plot of sensitivity against specificity. The ROC curve is a plot of the true positive rate against the false positive rate for the different possible cutpoints of a diagnostic test. It shows the trade-off between sensitivity and specificity depending on the selected cutpoint (any increase in sensitivity will be accompanied by a decrease in specificity). The area under an ROC curve (AUC) is a measure for the accuracy of a diagnostic test (the larger the area the better, optimum is 1, a random test would have a ROC curve lying on the diagonal with an area of 0.5; for reference: J. P. Egan. Signal Detection Theory and ROC Analysis, Academic Press, New York, 1975). The AUC of each ROC plot and the Wilcoxon p-value are shown in Table 12.

Stage

A further analysis of the colorectal carcinoma results according to stage of the carcinoma is shown in Table 7. In said table marker sensitivity based on two different methylation thresholds (>10% and >20%) is shown for all stages of CRC. For most markers, sensitivity is uniform across all CRC stages so these markers would be suitable for detection of all stages of CRC in a screening or monitoring test. There seems to be a trend for higher sensitivity in Stage II cancers. The less sensitive, more specific markers tend to identify earlier stage cancers (e.g. SEQ ID NO: 25 (Assay 3)) and could add to the sensitivity of a screening/monitoring test but also may be useful for other applications (biopsies, stool tests, etc).

Panel

The proportion of the analysed samples with methylation measured within various thresholds by combinations of assays in colorectal carcinoma and whole blood is shown in Tables 8-11. In each case, the tables show the proportion of samples within the given threshold, and additionally, the gain in detected samples of using both markers, as opposed to only the first marker.

Example 3

The following analysis was performed in order to confirm the gene Septin 9, (including its transcript variant Q9HC74) and panels thereof as a suitable marker for colorectal carcinoma screening and/or diagnosis based on analysis of DNA methylation in whole blood by validating the performance of assays in a large sample set.

The performance of the marker was analysed using an assay platform (Lightcycler) and real time assays (MSP and/or HeavyMethyl) as would be suitable for use in a reference or clinical laboratory setting. The performance of each marker was tested independently in colorectal tissue (normal adjacent tissue), colorectal carcinoma tissue and whole blood, in order to provide an indication of the accuracy of the marker.

The following primers and probes were used:

SEQ ID NO: 1 (Assay 7) using the Lightcycler probes according to Table 2 was performed using the following protocol:

| water | Fill up to final volume of 10 µl |
|---|---|
| MgCl2 | 3.5 |
| Primer forward | 0.3 |
| Primer reverse | 0.3 |
| Blocker | 4 |
| detect. Probe (fluo) | 0.15 |
| detect. Probe (red) | 0.15 |
| 1a + 1b reagent FastStart mix | 1 |
| DNA | |

LightCycler Program:

| activation: | 95° C. | 10 min | |
|---|---|---|---|
| 55 cycles: | 95° C. | 10 sec (20° C./s) | |
| | 56° C. | 30 sec (20° C./s) | detection |
| | 72° C. | 10 sec (20° C./s) | |
| melting curve: | 95° C. | 10 sec 20 | |
| | 40° C. | 10 sec 20 | |
| | 70° C. | 0 sec 0.1 | |
| cooling: | 40° C. | 5 sec | |

SEQ ID NO: 1 (Assay 7) using the Taqman probes according to Table 2 was performed using the following protocol:

Protocol:

| water | Fill up to final volume of 10 µl |
|---|---|
| MgCl2 | 3.5 |
| Primer 1 | 0.3 |
| Primer 2 | 0.3 |
| Blocker | 4 |
| TaqMan probe | 0.15 |
| 1a + 1b reagent (FastStart) | 1 |
| DNA | 10 µl |

Cycling Conditions

| activation: | 95° C. | 10 min | | |
|---|---|---|---|---|
| 50 cycles: | 95° C. | 10 sec | (20° C./s) | |
| | 56° C. | 30 sec | (20° C./s) | detection |
| | 72° C. | 10 sec | (20° C./s) | |
| melting curve: | 95° C. | 10 sec | 20 | |
| | 40° C. | 10 sec | 20 | |
| | 70° C. | 0 sec | 0.1 | |
| cooling: | 40° C. | 5 sec | | |

The C3 assay was performed in order to quantify the total amount of DNA in each sample. The C3 assay was performed as above in Example 2.

Each assay was run in duplicate on colorectal carcinoma, normal adjacent tissue and/or whole blood samples. Two sets of samples were analysed, sample set 1 as shown in Table 13 and sample set 2 as shown in Table 14.

Sample set 1 was analysed using the following assays detailed in Table 2:
SEQ ID NO: 1 (Assay 2)
SEQ ID NO: 26 (Assay 6)
SEQ ID NO: 24 (Assay 5)
SEQ ID NO: 25 (Assay 3)
Sample set 2 was analysed using the following assays as detailed in Table 2:
SEQ ID NO: 1 (Assay 7) both LightCycler (LC) and Taqman (Taq) variants and the following assays
SEQ ID NO: 28 (Assay 2)
SEQ ID NO: 24 (Assay 5b)
SEQ ID NO: 29 (Assay 2b)
as detailed in Table 17.

Only samples with greater than 4 ng of DNA were analysed. In sample set 1 27 blood samples and 91 colorectal cancer samples were analysed. In sample set 2 26 blood samples 22 non-adjacent colorectal tissue samples and 81 colorectal cancer samples were analysed.

All assays (C3 and methylation specific) were performed using the Lightcycler platform.

DNA Extraction and Bisulfite Treatment

The DNA was isolated from the all samples by means of the Magna Pure method (Roche) according to the manufacturer's instructions. The eluate resulting from the purification was then converted according to the following bisulfite reaction. The eluate was mixed with 354 µl of bisulfite solution (5.89 mol/l) and 146 µl of dioxane containing a radical scavenger (6-hydroxy-2,5,7,8-tetramethylchromane 2-carboxylic acid, 98.6 mg in 2.5 ml of dioxane). The reaction mixture was denatured for 3 min at 99° C. and subsequently incubated at the following temperature program for a total of 7 h min 50° C.; one thermospike (99.9° C.) for 3 min; 1.5 h 50° C.; one thermospike (99° C.) for 3 min; 3 h 50° C. The reaction mixture was subsequently purified by ultrafiltration using a Millipore Microcon™ column. The purification was conducted essentially according to the manufacturer's instructions. For this purpose, the reaction mixture was mixed with 300 μl of water, loaded onto the ultrafiltration membrane, centrifuged for 15 min and subsequently washed with 1×TE buffer. The DNA remains on the membrane in this treatment. Then desulfonation is performed. For this purpose, 0.2 mol/l NaOH was added and incubated for 10 min. A centrifugation (10 min) was then conducted, followed by a washing step with 1×TE buffer. After this, the DNA was eluted. For this purpose, the membrane was mixed for 10 minutes with 75 μl of warm 1×TE buffer (50° C.). The membrane was turned over according to the manufacturer's instructions. Subsequently a repeated centrifugation was conducted, with which the DNA was removed from the membrane. 10 μl of the eluate was utilized for the Lightcycler Real Time PCR assay.

Reaction Solutions and Thermal Cycling Conditions

SEQ ID NO: 26 Assay 6 (HeavyMethyl Assay)

Reaction Solution:

| water | |
|---|---|
| MgCl2 | 3.50 mM (buffer include 1 mM!) |
| Primer mix | 0.30 μM (each) |
| Blocker | 4.00 μM |
| detect. probes mix | 0.15 μM (each) |
| 1a + 1b reagent FastStart mix | 1.00 x |

Thermal Cycling Conditions:

| activation: | 95° C. | 10 min | | |
|---|---|---|---|---|
| 55 cycles: | 95° C. | 10 sec | (20° C./s) | |
| | 56° C. | 30 sec | (20° C./s) | detection |
| | 72° C. | 10 sec | (20° C./s) | |
| melting | 95° C. | 10 sec | 20 | |
| curve: | 40° C. | 10 sec | 20 | |
| | 70° C. | 0 sec | 0.1 | |
| cooling: | 40° C. | 5 sec | | |

SEQ ID NO: 25 Assay 3 (HeavyMethyl Assay)

Reaction Solution:

| water | |
|---|---|
| MgCl2 | 3.50 mM (buffer include 1 mM!) |
| Primer mix | 0.30 μM (each) |
| Blocker | 4.00 μM |
| detect. probes mix | 0.15 μM (each) |
| 1a + 1b reagent FastStart mix | 1.00 x |

Thermal Cycling Conditions:

| activation: | 95° C. | 10 min | | |
|---|---|---|---|---|
| 55 cycles: | 95° C. | 10 sec | (20° C./s) | |
| | 56° C. | 30 sec | (20° C./s) | detection |
| | 72° C. | 10 sec | (20° C./s) | |
| melting | 95° C. | 10 sec | 20 | |
| curve: | 40° C. | 10 sec | 20 | |
| | 70° C. | 0 sec | 0.1 | |
| cooling: | 40° C. | 5 sec | | |

SEQ ID NO: 24 Assay 5B (HeavyMethyl Assay)

Reaction Solution:

| water | |
|---|---|
| MgCl2 | 3.00 MM * |
| Primer forward | 0.30 μM |
| Primer reverse | 0.30 μM |
| Blocker | 4.00 μM |
| detect. probes fluo | 0.15 μM |
| detect. probes red | 0.15 μM |
| 1a + 1b reagent mix | 1.00 x |

Thermal Cycling Conditions:

| denat at | 95° C. | | | |
|---|---|---|---|---|
| | 95° C. | 10 min | | |
| 55 cycles: | | | | |
| denat at | 95° C. | 10 sec | (20° C./s) | |
| Annealing | 58° C. | 30 sec | (20° C./s) | detection |
| extension | 72° C. | 10 sec | (20° C./s) | |
| melting | 95° C. | 10 sec | 20 | |
| | 35° C. | 20 sec | 20 | |
| | 95° C. | 0 sec | 0.1 | |

SEQ ID NO: 24 Assay 5 (HeavyMethyl Assay)

Reaction Solution:

| water | |
|---|---|
| MgCl2 | 3.00 mM (buffer include mM!) |
| Primer forward | 0.30 μM |
| Primer reverse | 0.30 μM |
| Blocker | 4.00 μM |
| LightCycler Probe | 0.15 μM |
| LightCycler Probe | 0.15 μM |
| 1a + 1b reagent mix | 1.00 x |

Thermal Cycling Conditions:

| denat at | 95° C. | | | |
|---|---|---|---|---|
| | 95° C. | 10 min | | |
| 55 cycles: | | | | |
| denat at | 95° C. | 10 sec | (20° C./s) | |
| Annealing | 58° C. | 30 sec | (20° C./s) | detection |
| extension | 72° C. | 10 sec | (20° C./s) | |
| melting | 95° C. | 10 sec | 20 | |
| | 35° C. | 20 sec | 20 | |
| | 95° C. | 0 sec | 0.1 | |

SEQ ID NO: 1 Assay 2 (MSP Assay)

Reaction Solution:

| Water (3315932) | |
|---|---|
| MgCl2 (2239272) | 3.50 MM (*) |
| Primer forward | 0.60 μM |
| Primer reverse | 0.60 μM |
| detect. Probe | 0.30 μM |
| 1a + 1b reagent FastStart mix | 1.00 x |

Thermal Cycling Conditions:

| activation: | 95° C. | 10 min |  |  |
|---|---|---|---|---|
| 50 cycles: | 95° C. | 15 sec |  |  |
|  | 62° C. | 45 sec |  |  |
| cooling: | 40° C. | 5 sec |  |  |

SEQ ID NO: 1 Assay 7 (LightCycler Probe HeavyMethyl Assay)

Reaction Solution:

| water | |
|---|---|
| MgCl2 | 3.50 mM (buffer include mM!) |
| Primer 1 | 0.30 μM |
| Primer 2 | 0.30 μM |
| Blocker | 4.00 μM |
| detect. Probe (fluo) | 0.15 μM |
| detect. Probe (red) | 0.15 μM |
| 1a + 1b reagent (FastStart) | 1.00 x |

Thermal Cycling Conditions:

| activation: | 95° C. | 10 min | | |
|---|---|---|---|---|
| 50 cycles: | 95° C. | 10 sec | (20° C./s) | |
|  | 56° C. | 30 sec | (20° C./s) | detection |
|  | 72° C. | 10 sec | (20° C./s) | |
| melting | 95° C. | 10 sec | 20 | |
| curve: | 40° C. | 10 sec | 20 | |
|  | 70° C. | 0 sec | 0.1 | |
| cooling: | 40° C. | 5 sec | | |

SEQ ID NO: 1 Assay 7 (Taqman HeavyMethyl Assay)

Reaction Solution:

| water | |
|---|---|
| MgCl2 | 3.50 mM (buffer include mM!) |
| Primer 1 | 0.30 μM |
| Primer 2 | 0.30 μM |
| Blocker | 4.00 μM |
| detection probe 1 | 0.15 μM |
| detection probe 2 | 0.15 μM |
| 1a + 1b reagent mix | 1.00 x |

Thermal Cycling Conditions:

| activation: | 95° C. | 10 min | | |
|---|---|---|---|---|
| 50 cycles: | 95° C. | 10 sec | (20° C./s) | |
|  | 56° C. | 30 sec | (20° C./s) | detection |
|  | 72° C. | 10 sec | (20° C./s) | |
| melting | 95° C. | 10 sec | 20 | |
| curve: | 40° C. | 10 sec | 20 | |
|  | 70° C. | 0 sec | 0.1 | |
| cooling: | 40° C. | 5 sec | | |

SEQ ID NO: 28 Assay 2 (HeavyMethyl Assay)

Reaction Solution:

| water | |
|---|---|
| MgCl2 | 3.50 mM (buffer include mM!) |
| Primer 1 | 0.30 μM |
| Primer 2 | 0.30 μM |
| Blocker | 4.00 μM |
| detection probe 1 | 0.15 μM |
| detection probe 2 | 0.15 μM |
| 1a + 1b reagent mix | 1.00 x |

Thermal Cycling Conditions:

| activation: | 95° C. | 10 min | | |
|---|---|---|---|---|
| 50 cycles: | 95° C. | 10 sec | (20° C./s) | |
|  | 56° C. | 30 sec | (20° C./s) | detection |
|  | 72° C. | 10 sec | (20° C./s) | |
| melting | 95° C. | 10 sec | 20 | |
| curve: | 40° C. | 10 sec | 20 | |
|  | 70° C. | 0 sec | 0.1 | |
| cooling: | 40° C. | 5 sec | | |

SEQ ID NO: 29 Assay 2B (HeavyMethyl Assay)

Reaction Solution:

| water | |
|---|---|
| MgCl2 | 3.00 mM (buffer include mM!) |
| Primer 1 | 0.30 μM |
| Primer 2 | 0.30 μM |
| Blocker | 4.00 μM |
| detect. Probe (fluo) | 0.15 μM |
| detect. Probe (red) | 0.15 μM |
| 1a + 1b reagent (FastStart) | 1.00 x |

Thermal Cycling Conditions:

| activation: | 95° C. | 10 min | | |
|---|---|---|---|---|
| 50 cycles: | 95° C. | 10 sec | (20° C./s) | |
|  | 58° C. | 30 sec | (20° C./s) | detection |
|  | 72° C. | 10 sec | (20° C./s) | |
| melting curve: | 95° C. | 10 sec | 20 | |
|  | 40° C. | 10 sec | 20 | |
|  | 70° C. | 0 sec | 0.1 | |

SEQ ID NO: 29 Assay 2 (HeavyMethyl Assay)

Reaction Solution:

| water | |
|---|---|
| MgCl2 | 3.50 mM (buffer include mM!) |
| Primer 1 | 0.30 μM |
| Primer 2 | 0.30 μM |
| Blocker | 4.00 μM |
| detection probe 1 | 0.15 μM |
| detection probe 2 | 0.15 μM |
| 1a + 1b reagent mix | 1.00 x |

Thermal Cycling Conditions:

| activation: | 95° C. | 10 min | | |
|---|---|---|---|---|
| 55 cycles: | 95° C. | 10 sec | (20° C./s) | |
| | 56° C. | 30 sec | (20° C./s) | detection |
| | 72° C. | 10 sec | (20° C./s) | |
| melting curve: | 95° C. | 10 sec | 20 | |
| | 40° C. | 10 sec | 20 | |
| | 70° C. | 0 sec | 0.1 | |
| cooling: | 40° C. | 5 sec | | |

Data Interpretation

Calculation of DNA Concentration.

The Cp (crossing point values) as calculated by the Lightcycler instrument software were used to determine DNA concentration. The DNA concentration was calculated by reference of the CP value of each well to a standard curve for both the methylation assays and the C3 assay.

In most cases each assay was run twice per sample, resulting in multiple measurements per sample.

Percentage Methylation

All samples that measured less than 4 ng DNA using the C3 assay were not further considered. For each sample the detected percentage methylation was calculated as the measured concentration of DNA quantified using the methylation assays over the concentration of DNA in the sample as quantified by the C3 assay.

Detection of methylation was determined at multiple different threshold levels, see tables) as well as at all methylation levels (i.e. any samples wherein methylation was detected were deemed positive).

The sensitivity of each assay was determined from the colorectal carcinoma sample positive detection rate, wherein sensitivity was determined as the % samples wherein methylation was positively detected (i.e. true positives).

The specificity of each assay was determined from the whole blood sample negative detection rate (i.e. true negative detection rate) wherein false positives were discounted from the total number of analysed samples.

Results

The proportion or number of the analysed samples with methylation measured within a given threshold by individual assays are shown in Tables 15 (Sample set 1) and in Table 16 (Sample set 2). Wherein at least one of the two replicates tested positive within a given threshold the sample was considered as positive. The panel data was compiled by determining the proportion or number of the analysed samples with methylation measured within a given threshold using at least one assay of the panel. Wherein at least one of the two replicates tested positive within a given threshold the sample was considered as positive.

SEQ ID NO: 1 Assay 2 was further tested in a set of 14 breast cancer samples, 12 colorectal cancer samples and 10 whole blood samples (Sample set 3). The proportion or number of the analysed samples with methylation measured within a given threshold by individual assays are shown in Tables 18.

Example 4

Other Cancers

The following analysis was performed in order to confirm the gene Septin 9, (including its transcript variant Q9HC74) and panels thereof as a suitable marker for the screening and/or diagnosis of other cancers, based on analysis of DNA methylation in whole blood by validating the performance of assays in a large sample set.

The performance of the marker was analysed using HeavyMethyl Assay 7 of SEQ ID NO: 1 according to Table 2, reactions conditions were as according to Example 2.

Figure 3:
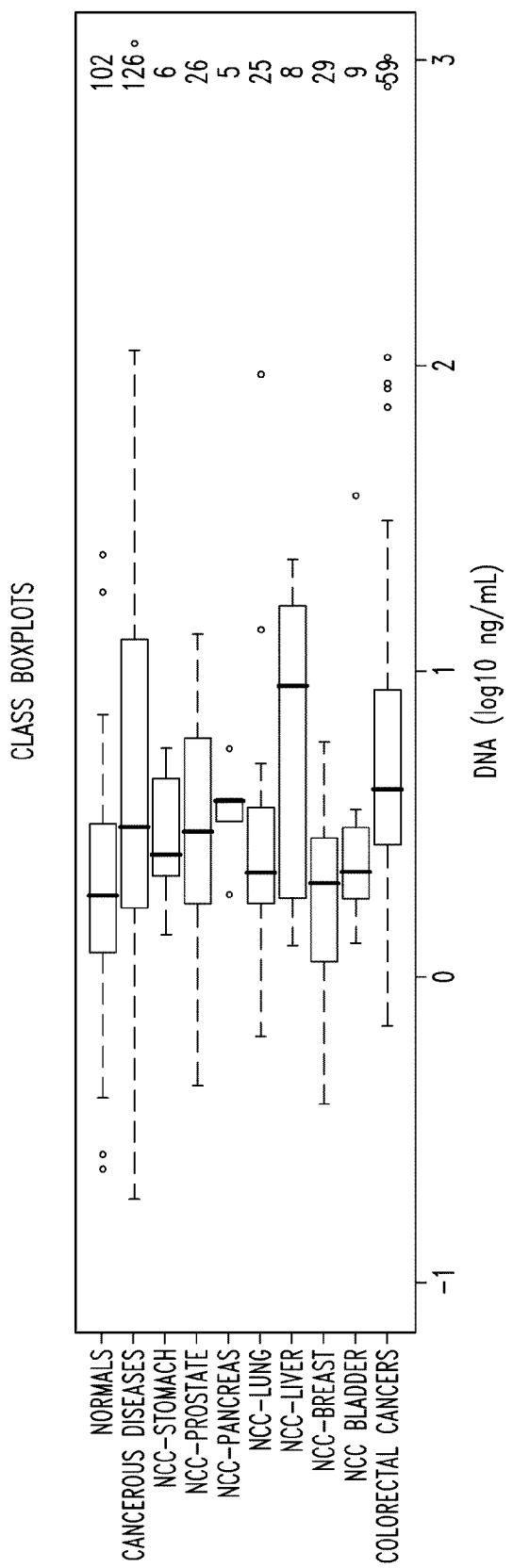
FIG. 3 shows the methylation levels measured in other cancers according to Example 4.
Figure 4:
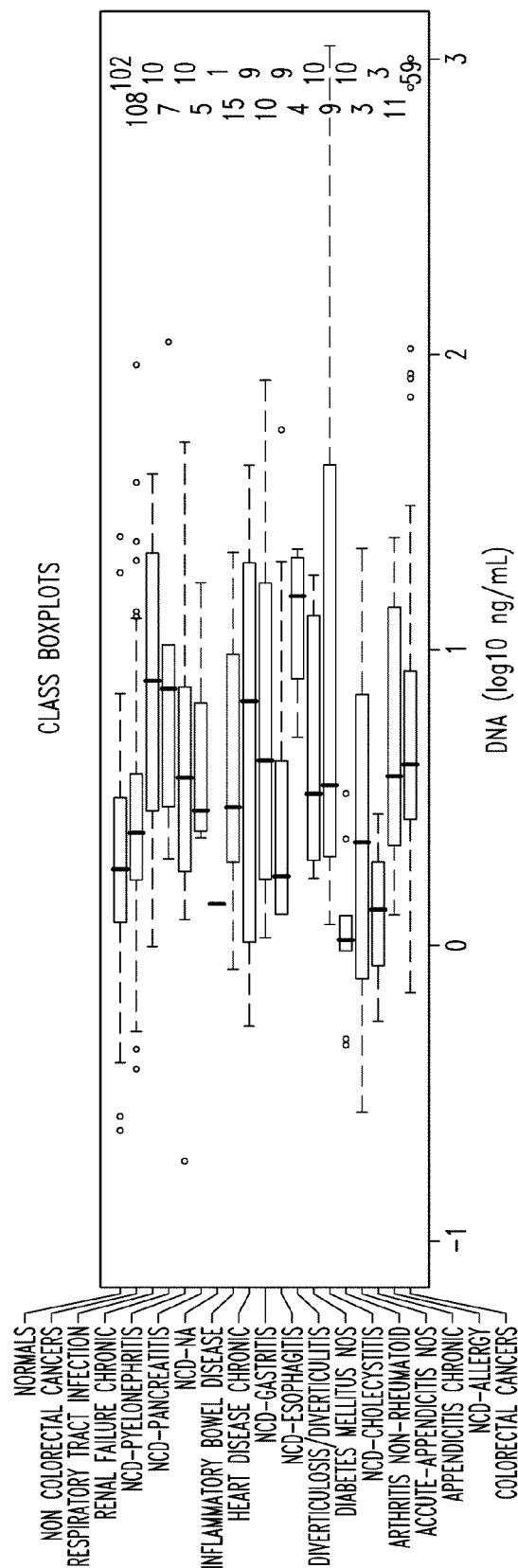
FIG. 4 shows the methylation levels measured in other non-cancerous diseases, according to Example 4.
Figure 5:
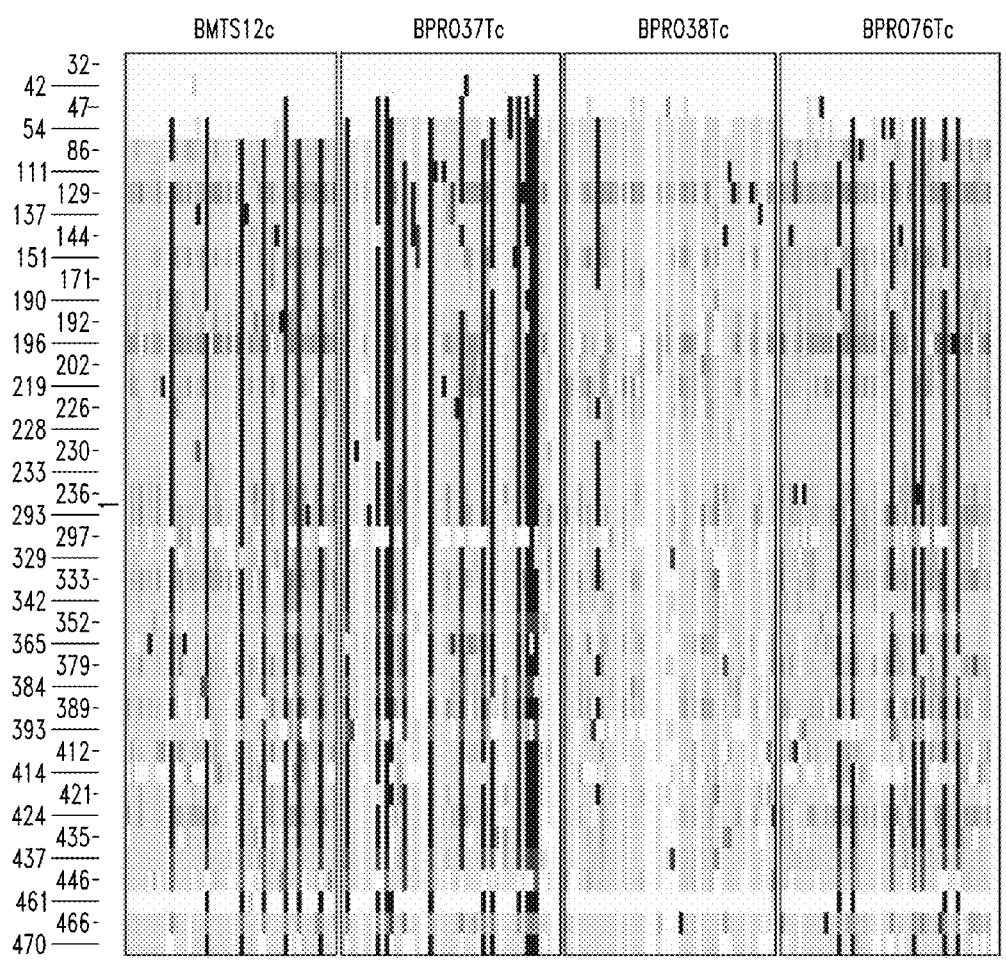
FIGS. 5 to 29 provide matrices of the bisulfite sequencing data according to Example 5. Each column of the matrices represents the sequencing data for a replicate of one sample, all replicates of each sample are grouped together in one block. Each row of a matrix represents a single CpG site within the fragment. The CpG number of the amplificate is shown to the left of the matrices. The amount of measured methylation at each CpG position is represented by colour from light grey (0% methylation), to medium grey (50% methylation) to dark grey (100% methylation). Some amplificates, samples or CpG positions were not successfully sequenced and these are shown in white.
Figure 6:
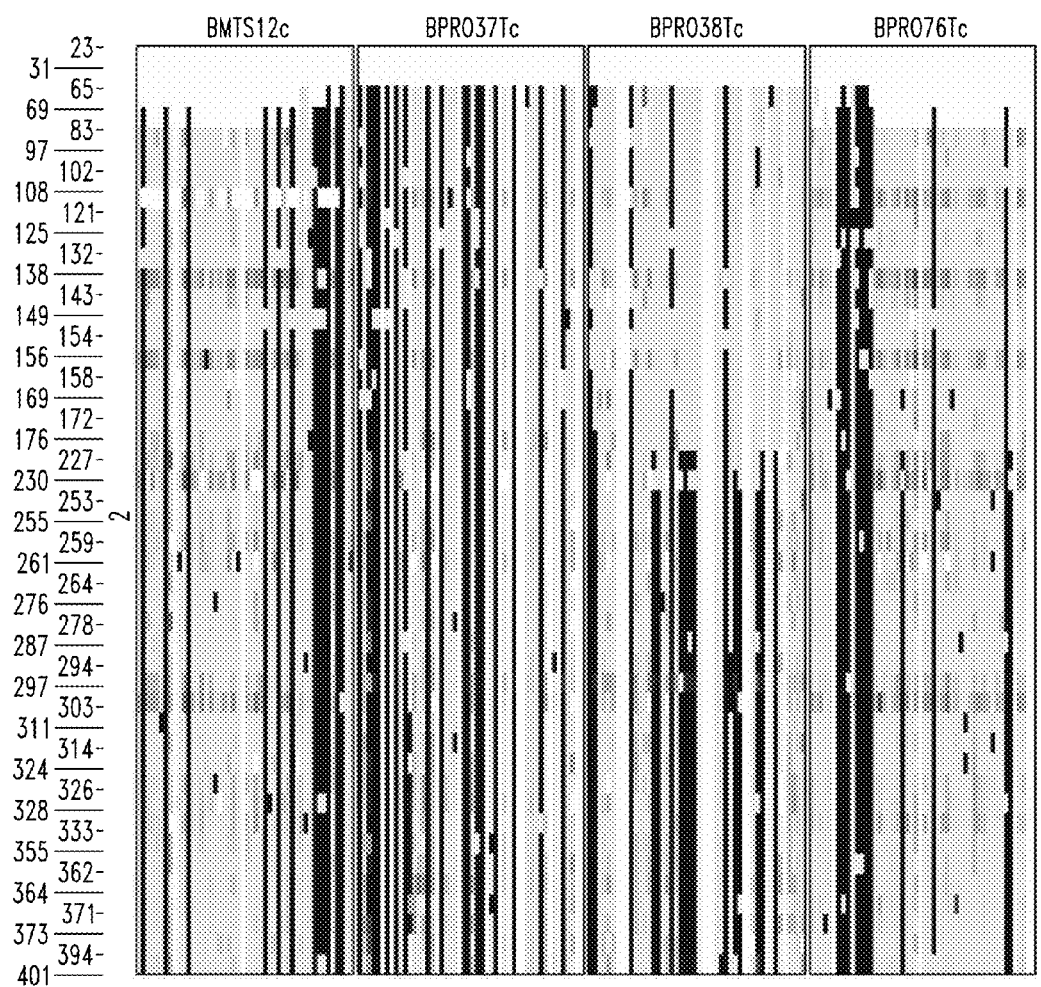
Figure 7:
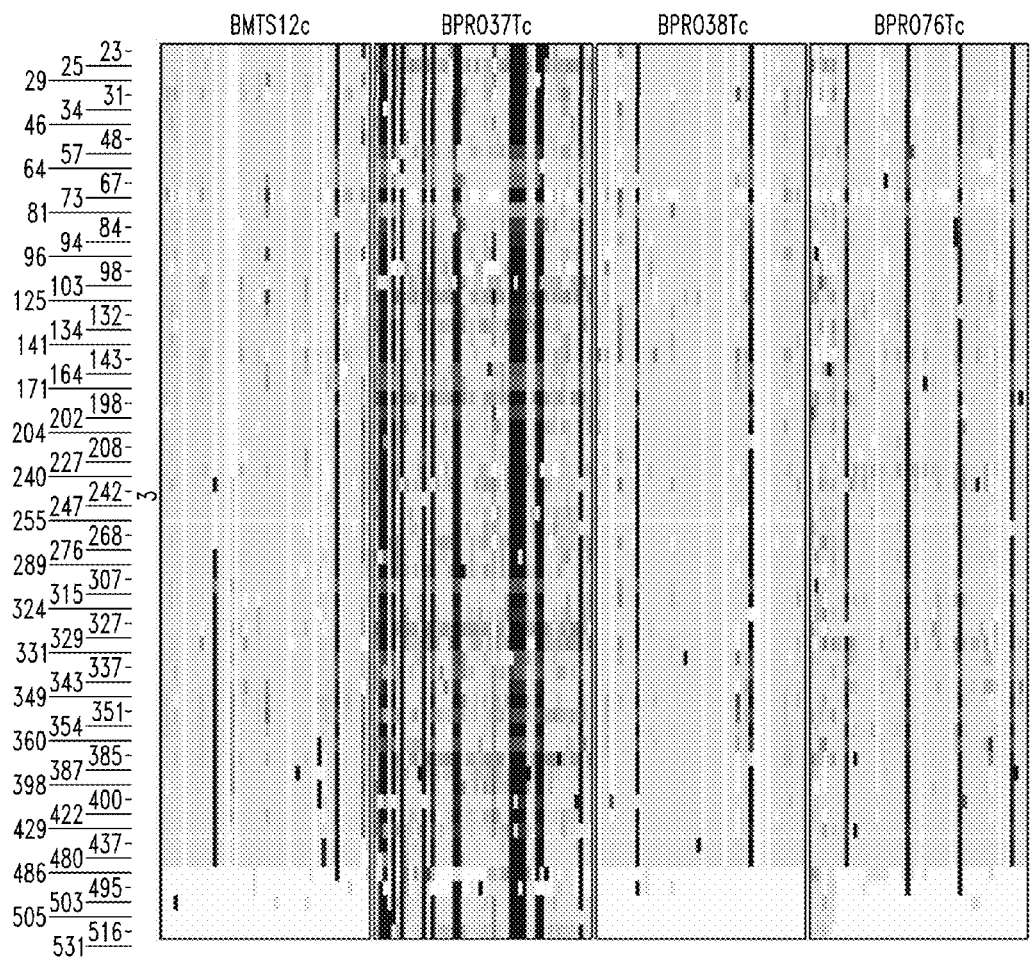
Figure 8:
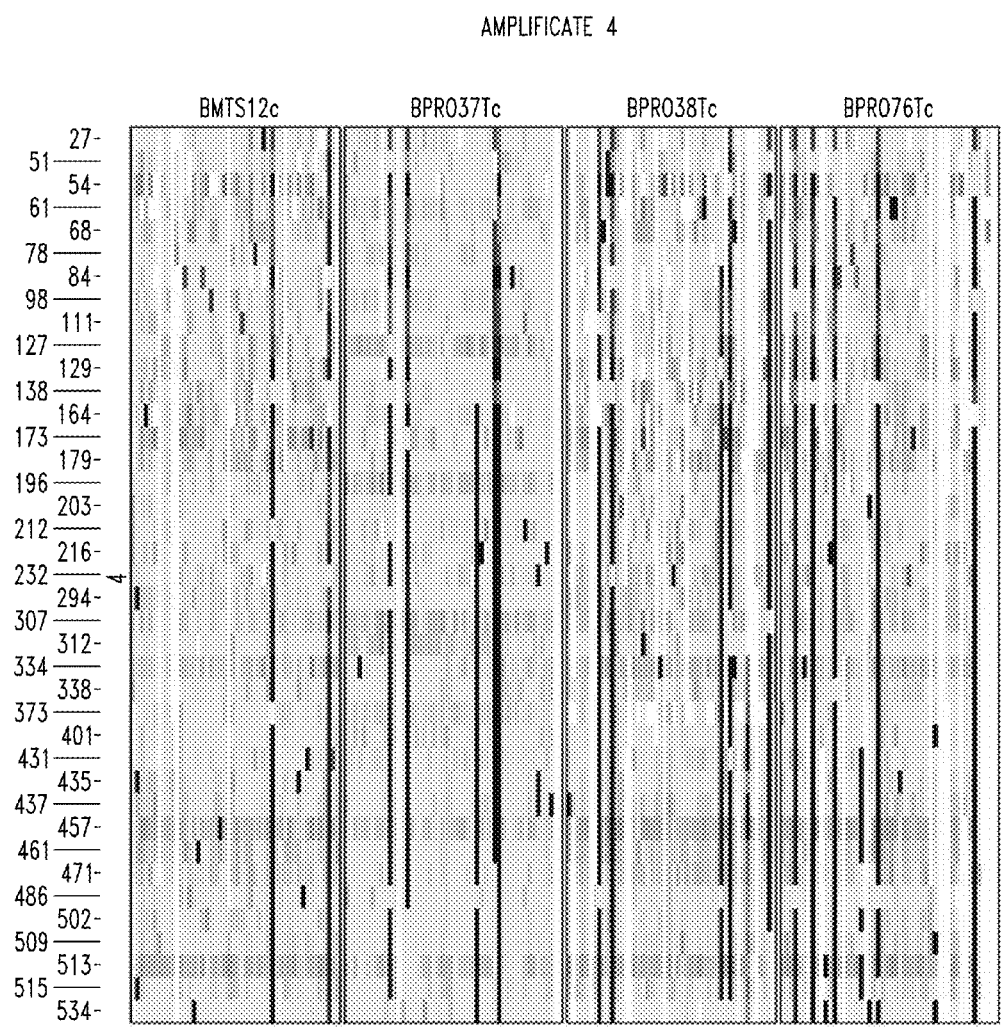
Figure 9:
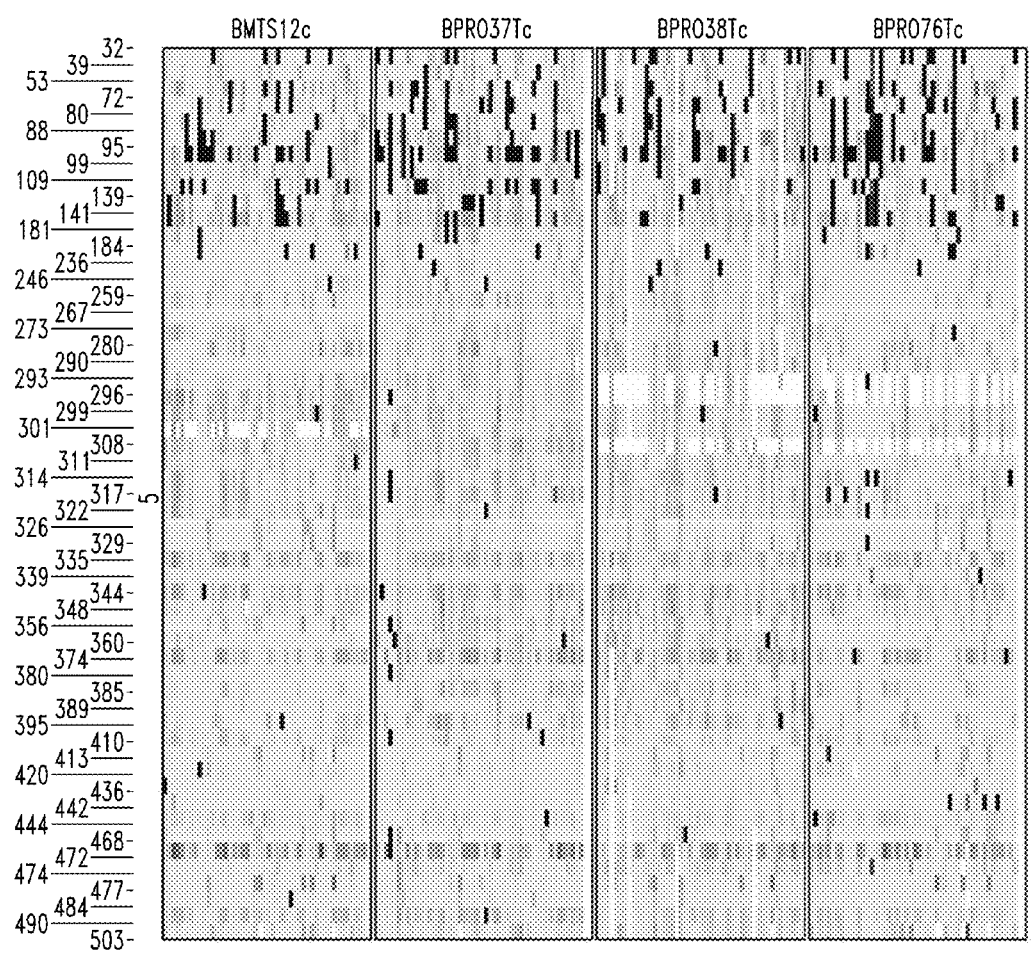
Figure 10:
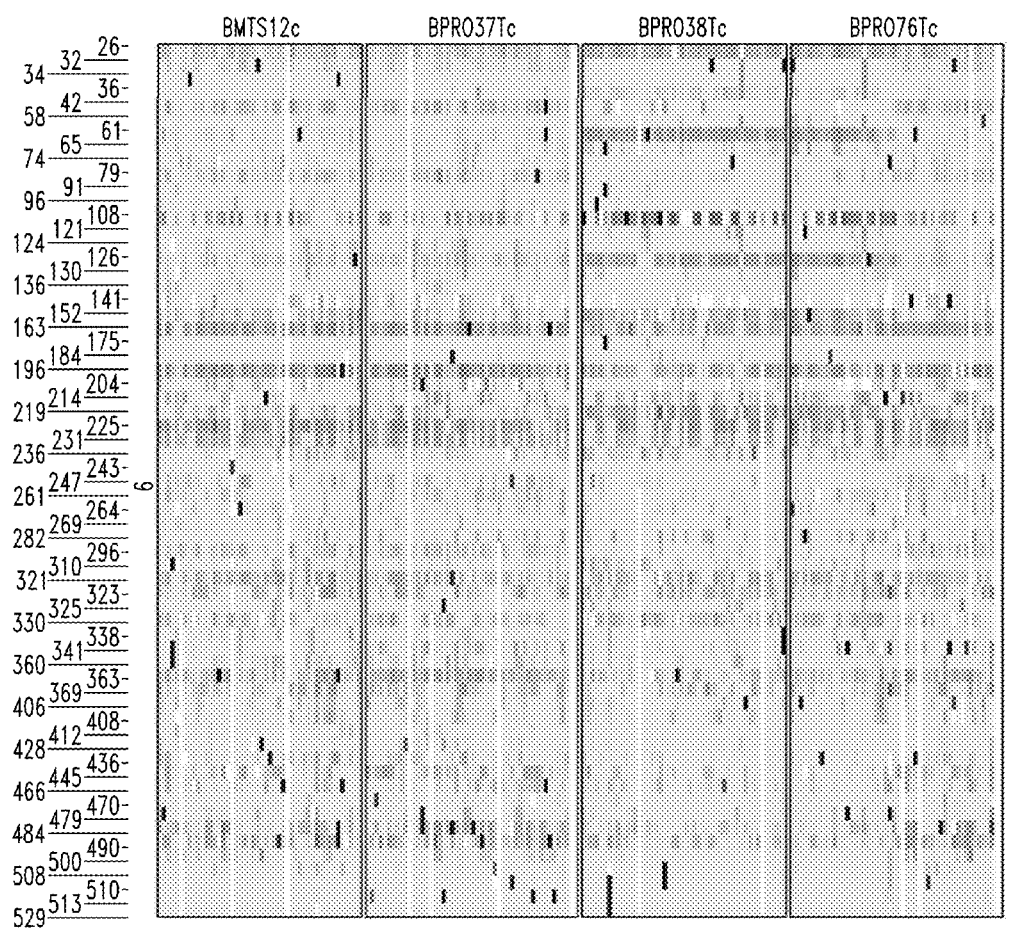
Figure 11:
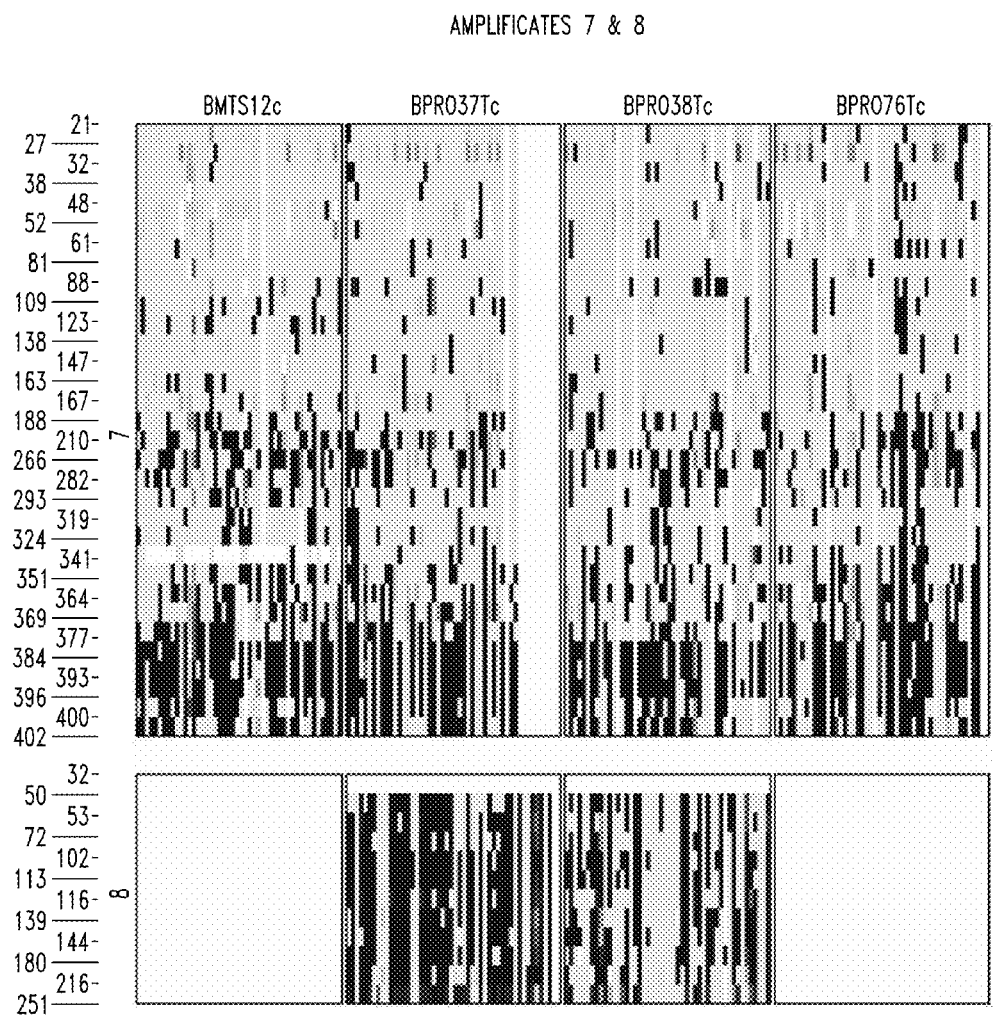
Figure 12:
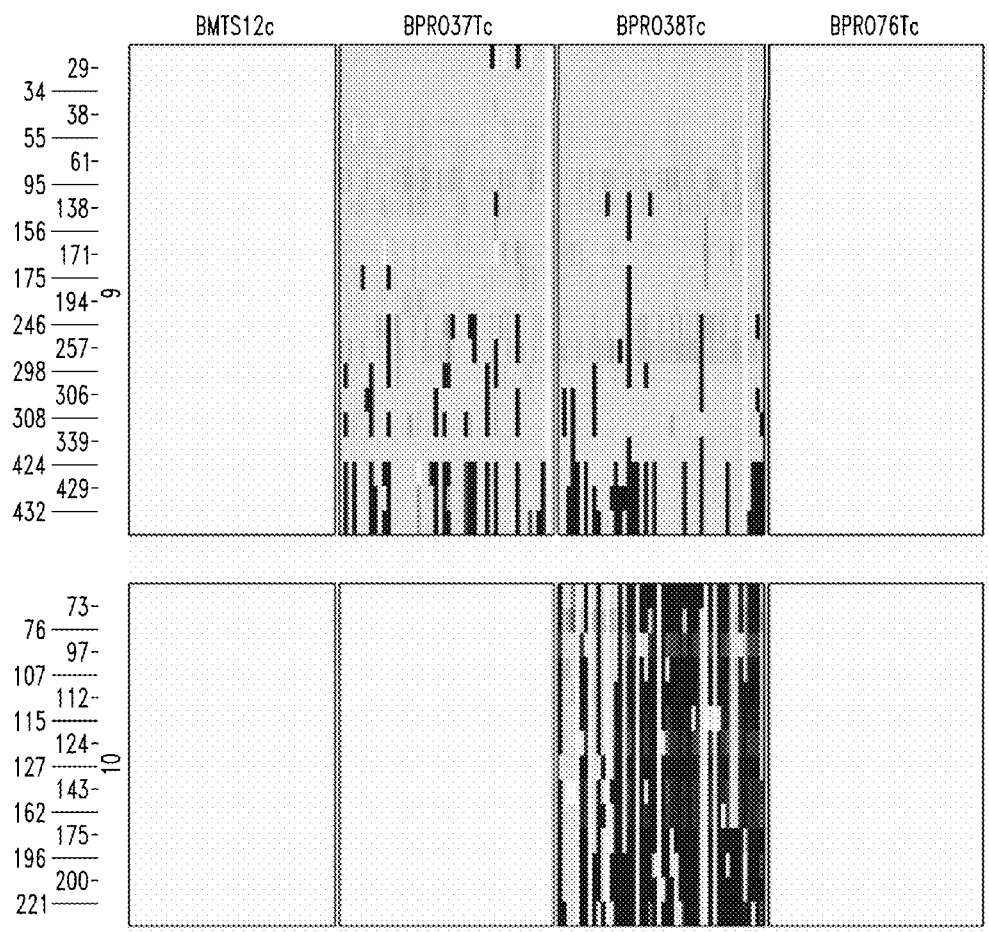
Figure 13:
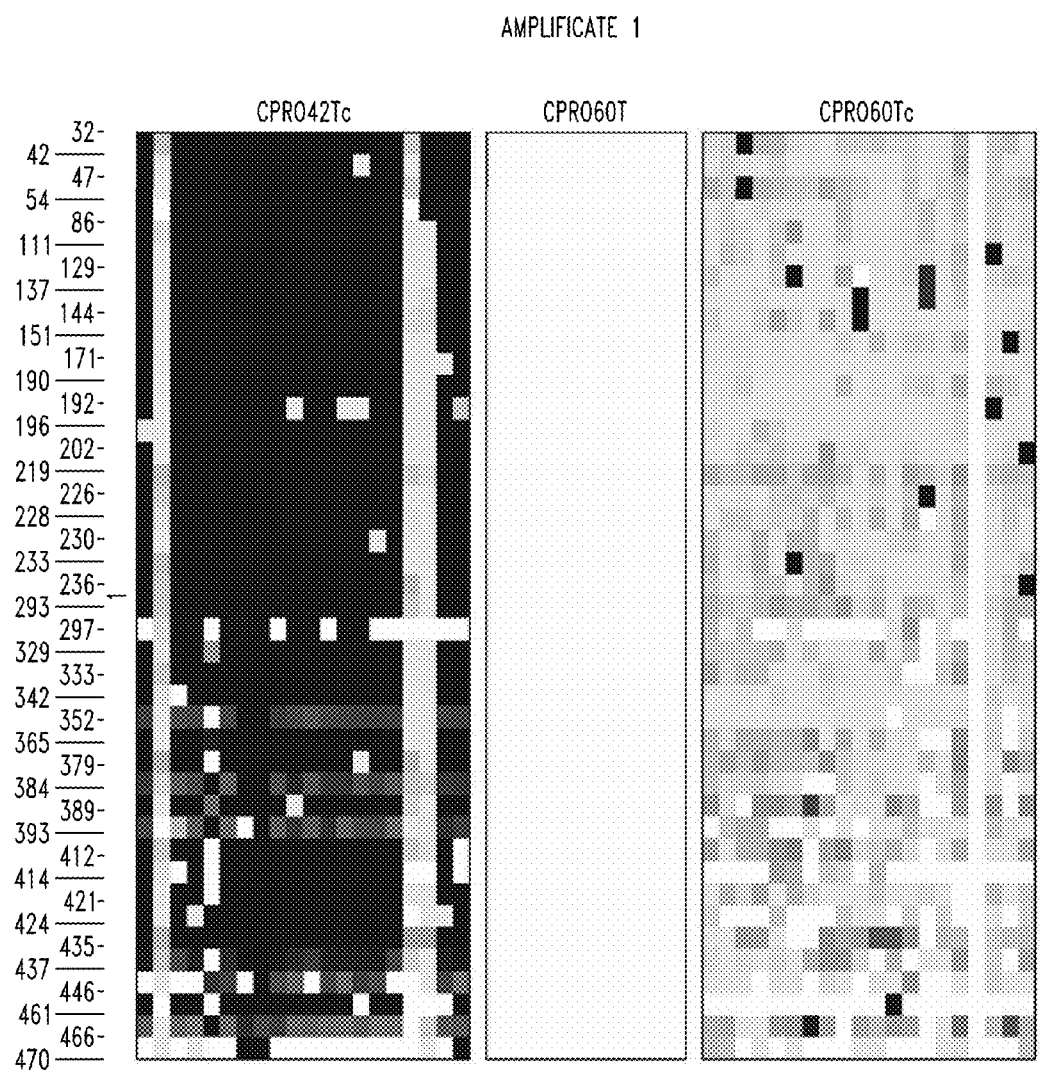
Figure 14:
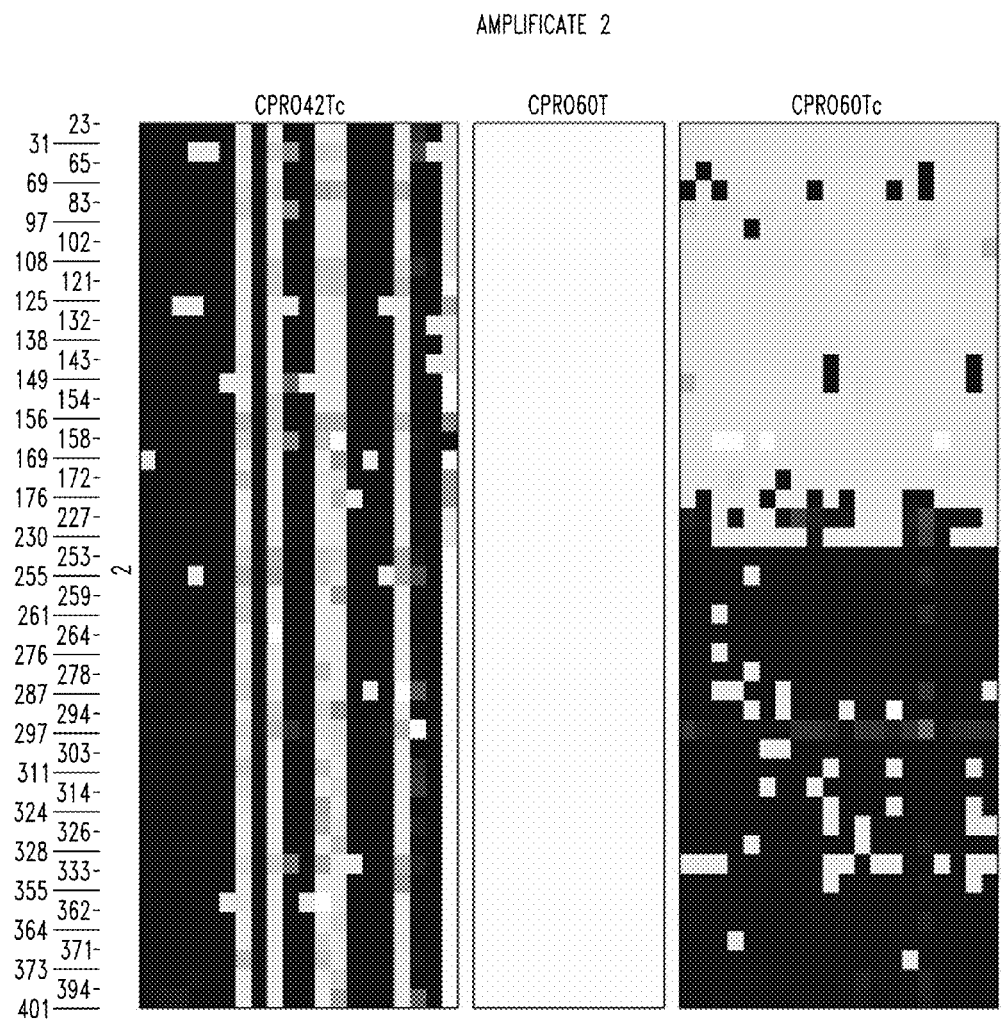
Figure 15:
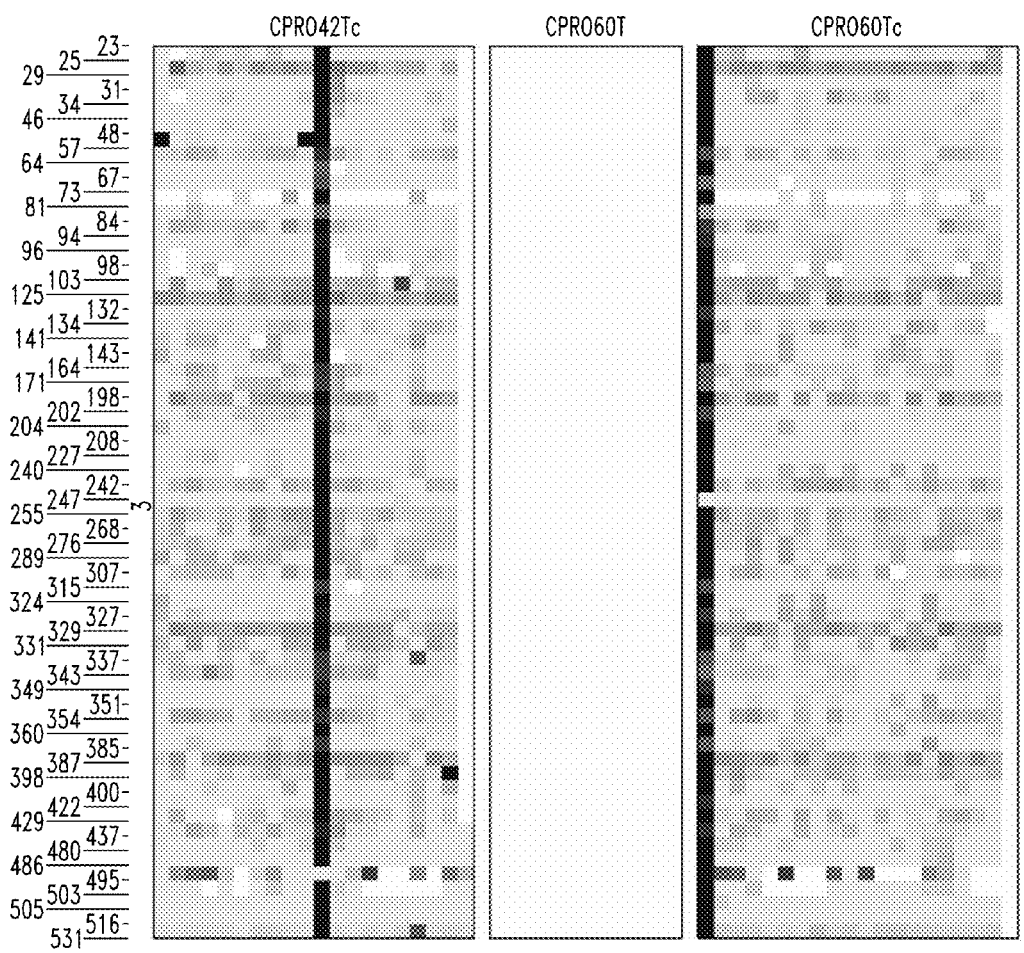
Figure 16:
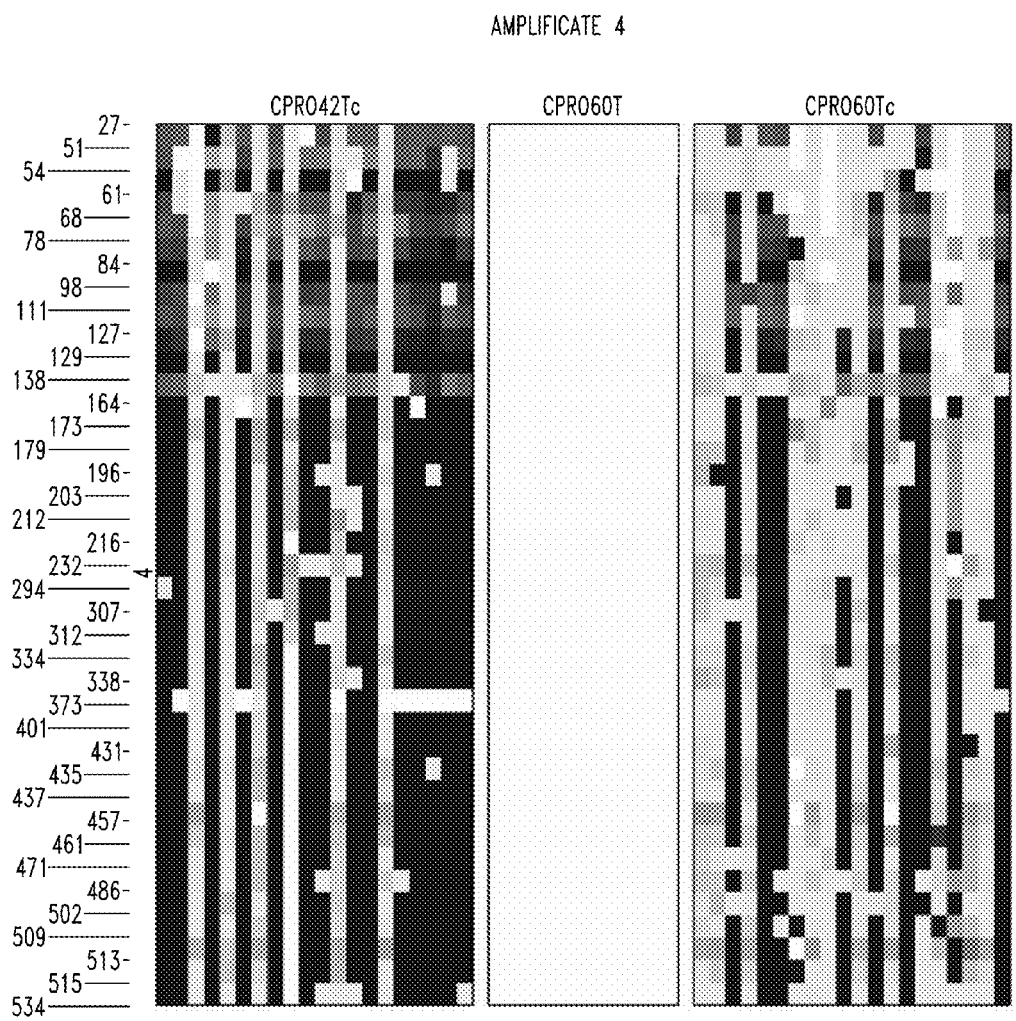
Figure 17:
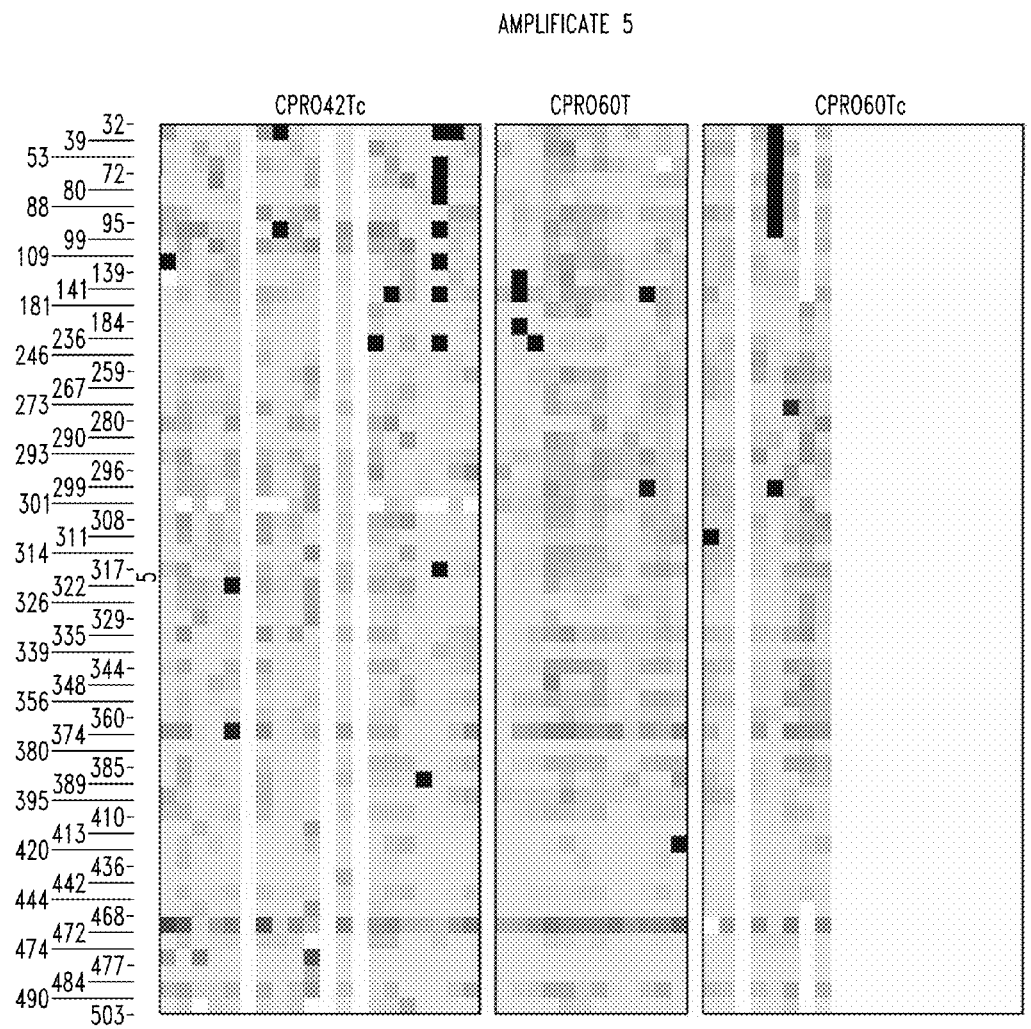
Figure 18:
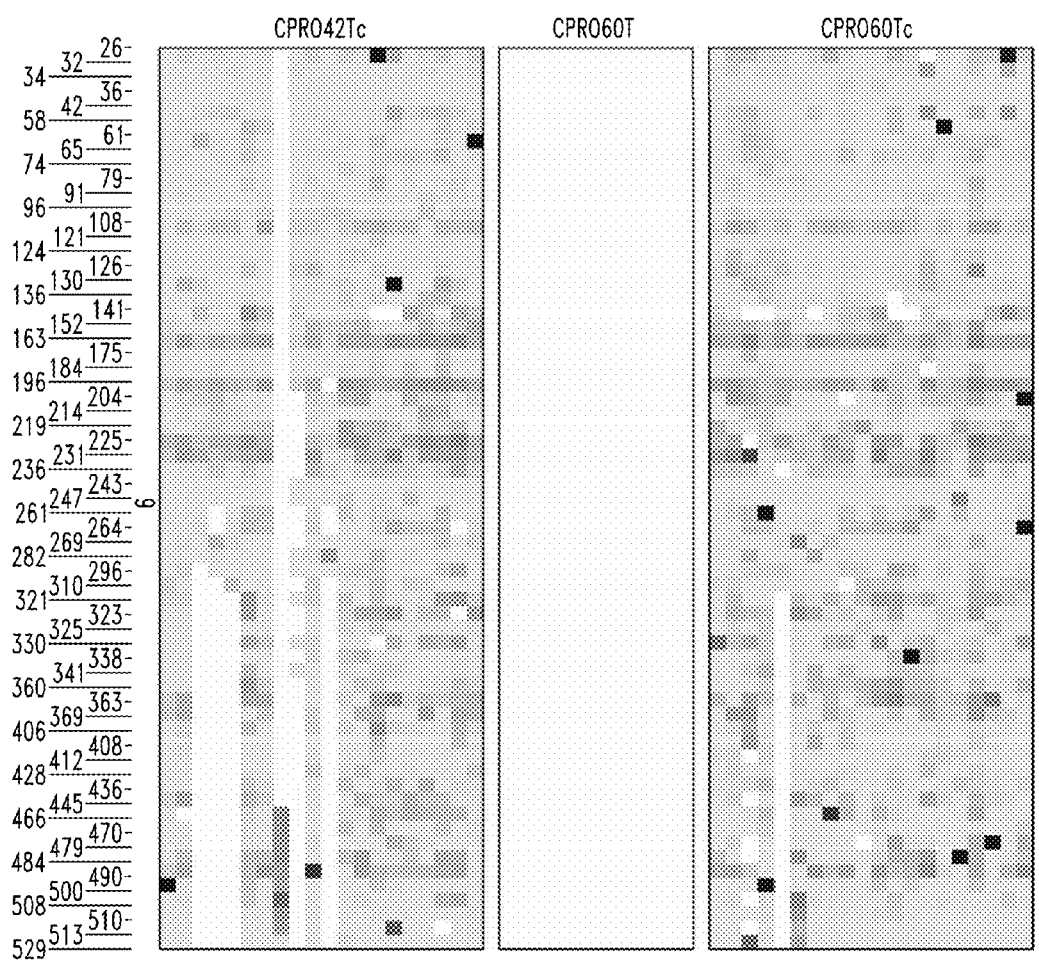
Figure 19:
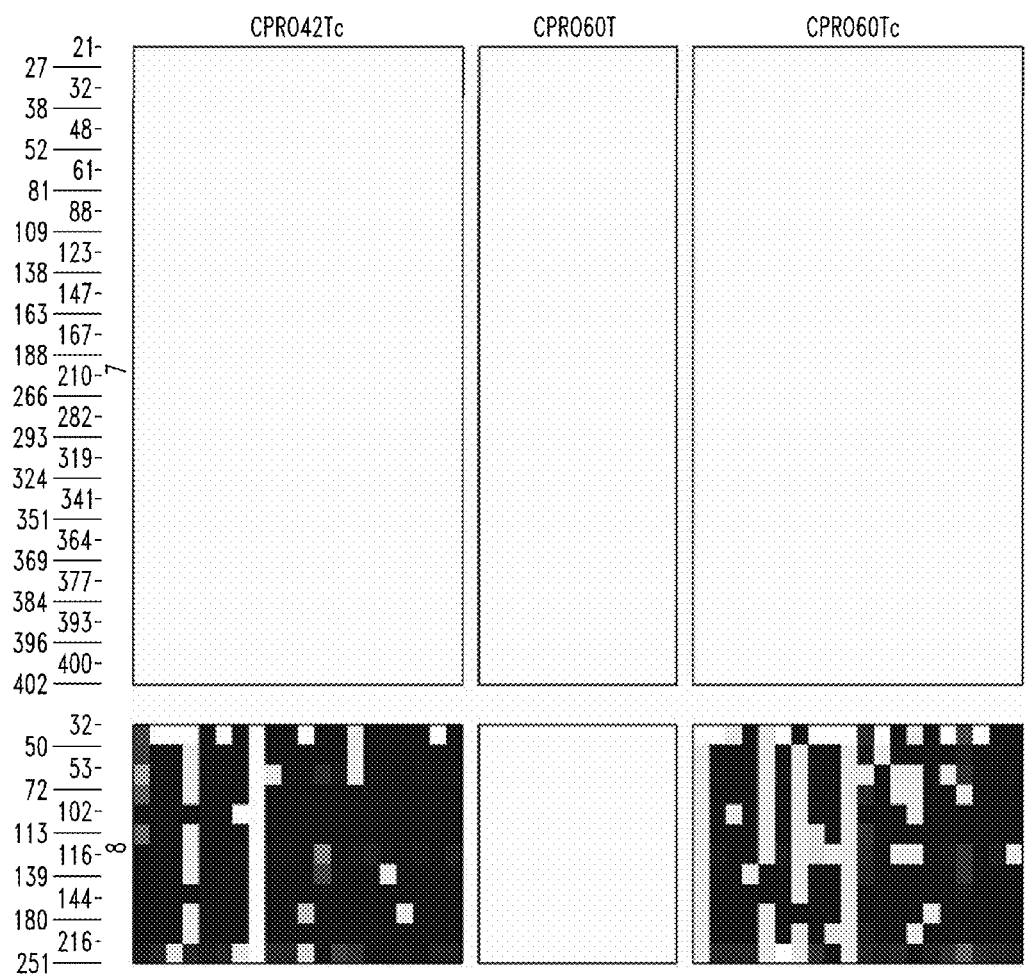
Figure 20:
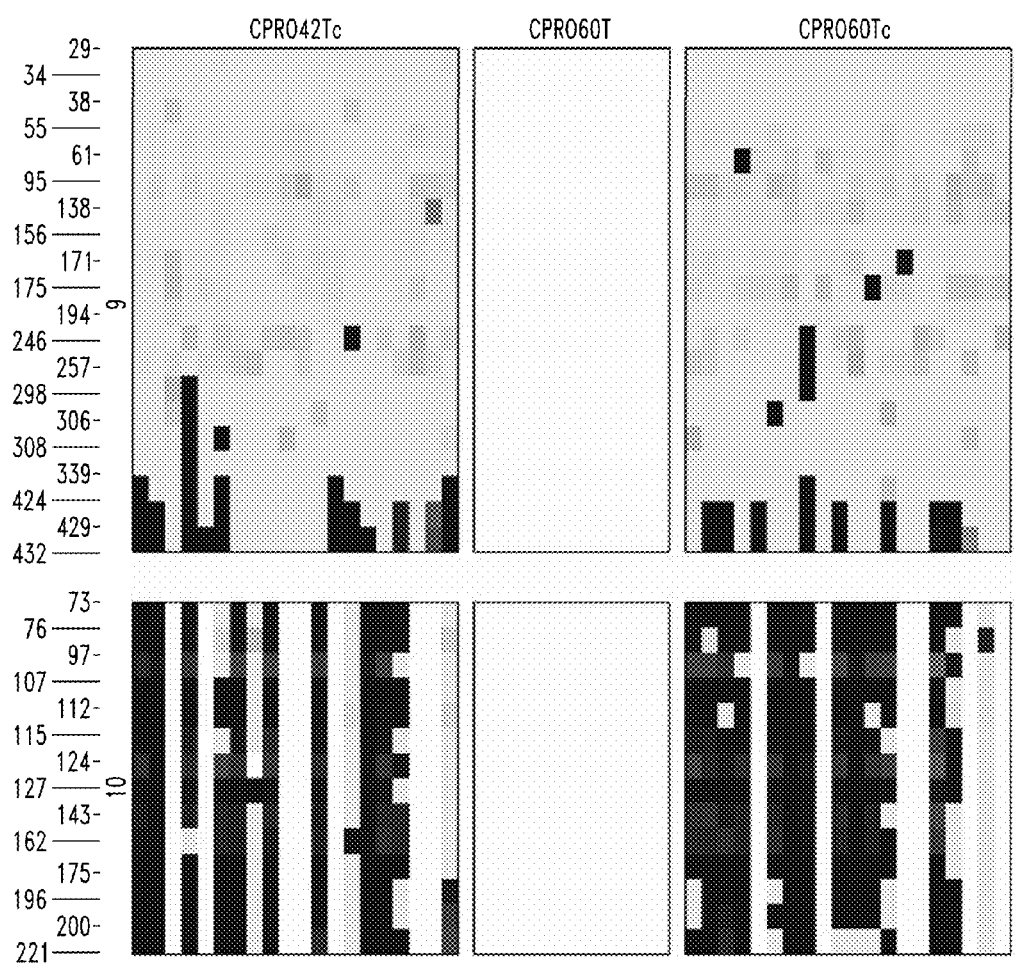

Table 20 shows the number of samples tested in each class, and the number of samples wherein both replicates tested positive for methylation. FIG. 3 shows the methylation levels measured in other cancers, as can be seen the gene is methylated across multiple cancer types. However, only liver cancer is methylated at equal or higher rates than colorectal cancer. FIG. 4 shows the methylation levels measured in other non-cancerous diseases, as can be seen only pyleonephritis is methylated at equal or higher rates than colorectal cancer.

Example 5

Bisulfite Sequencing

Sequencing of the Septin 9 Gene

It has been postulated that the gene Septin 9 has from 4 (see previous discussion regarding the Ensembl database) to at least 6 different transcript variants (at the 5' end, see Russell et al. Oncogene. 2001 Sep. 13; 20(41):5930-9). Of the variants referred to by Russell et al. amplicons were designed to cover the CpG islands or CpG rich regions covering for 4 variants (alpha, beta, gamma and epsilon). There are 2 CpG islands overlapping 2 of the variants, epsilon and gamma. The beta variant appears to be regulated by the gamma CPG island.

Samples from 12 patients were analysed, the level of Septin 9 methylation having been previously quantified by means of HeavyMethyl assay, as described above. Two samples had greater than 20% methylation (Sample C group), 4 samples had 10% to 20% methylation (Sample B group) and 6 samples had previously displayed up to 10% methylation (Sample A group).

Furthermore, DNA of 3 whole blood samples from subjects with no apparent disease was also used for alpha and beta amplicons (Sample N group).

DNA Extraction and Bisulfite Treatment

DNA was isolated with QIAGEN Genomic-Tip 500/G or 100/G according to the manufacturer's instructions. The purified genomic DNA was then converted according to the following bisulfite reaction.

2 ug of DNA in 100 ul was mixed with 354 µl of bisulfite solution (10.36 g sodium bisulfite & 2.49 g sodium sulfite in 22 ml nuclease-free water) and 146 µl of dioxane containing a radical scavenger (6-hydroxy-2,5,7,8-tetramethylchromane 2-carboxylic acid, 323 mg in 8.2 ml of dioxane). The bisulfite reaction was as follows:

| Time | Speed | Action |
|---|---|---|
| 3 min | | Water bath 99.9° C. |
| 30 min | 1000 rpm | Thermomixer 60° C. |
| 3 min | | Water bath 99.9° C. |
| 1.5 hour | 1000 rpm | Thermomixer 60° C. |
| 3 min | | Water bath 99.9° C. |
| 3 hour | 1000 rpm | Thermomixer 60° C. |

The reaction mixture was subsequently purified by ultrafiltration using a Millipore Microcon™ column. The purification was conducted according to the manufacturer's instructions. More specifically for desulfonation and washing:

| Time | Volume | Speed | Action |
|---|---|---|---|
| | 200 µl | | Sterile water to bisulfite reaction; mix, vortex & spin |
| | 400 µl | | Bisulfite mix to Microcon column |
| 20 min | | 14,000 g | Discard tube with flow through; replace with new tube |
| | 400 µl | | Remaining bisulfite mix to the same Microcon filter |
| 20 min | | 14,000 g | Discard tube with flow through; replace with new tube |
| | 400 µl | | 0.2 M NaOH |
| 12 min | | 14,000 g | Discard tube with flow through; replace with new tube |
| | 400 µl | | 0.1 M NaOH |
| 12 min | | 14,000 g | Discard tube with flow through; replace with new tube |
| | 400 µl | | ddH$_2$O |
| 12 min | | 14,000 g | Discard tube with flow through; replace with new tube |
| | 400 µl | | ddH$_2$O |
| 12 min | | 14,000 g | Discard tube with flow through; replace with new tube |

Then 50 µl of Bisulfite TE buffer (pre-warmed to 50° C.; 0.1 mM EDTA in 10 mM Tris) was added to the membrane and incubated for 10 min under agitation (1000 rpm). The column was inverted into a 1.7 ml low-retention tube and spun at 1000 g for 7 minutes to elute the DNA. The DNA concentration was determined by real-time PCR assay of a control sequence (HB14).

Amplification

See Table 21 for amplicons and PCR primers. Amplicons with "rc" in their names were amplified from the Bis2 strand, others from the Bis1 strand.

Fragments of interest were amplified using the following conditions in 25 ul reactions.

PCR Reaction:

| | 1x volume (ul) | Final conc. |
|---|---|---|
| 10X DyNAzyme EXT buffer w/ MgCl$_2$ | 2.5 | 1X |
| 2 mM dNTPs | 2.5 | 200 uM each |
| Rev/For primer combo (10 uM stock) | 1.25 | 0.5 uM each |
| DyNAzyme EXT polymerase 1 U/ul | 0.5 | 0.5 unit total |
| Bisulfite Treated DNA (@10 ng/ul) | 2.5-5 | 25-50 ng total |
| DMSO 100% | 0-0.5 | 0-2% |

Cycling Conditions:
3 min 94° C.; 20 s 94° C.; 30 s 54° C.; 45 s 72° C. (38-42 cycles); 10 min 72° C.

Purification of the PCR Product

PCR product was purified with the Montage™ DNA Gel Extraction Kit according the manufacturer's instruction. In brief, PCR reaction was run on 1% modified TAE (containing 0.1 mM EDTA instead of the 1.0 mM EDTA in standard TAE) agarose gel. The DNA band of interest was cut and excised. The gel slice was place in a Montage DNA gel Extraction Device, and span at 5000 g for 10 minutes to collect the DNA solution. The purified DNA was further concentrated to 10 ul.

TA Cloning

The PCR product was cloned and propagated with the Invitrogen TOPO® TA Cloning kit according to manufacturer's instruction. In brief, 2 ul of purified and concentrated PCR product was used in a TOPO cloning reaction to clone it into the vector pCR®2.1-TOPO. Transformation was done with the chemically competent *E. coli* strain TOP10.

Sequencing

Individual colonies were picked and cultured in LB (50 ug Carbenicillin/ml LB for selection). 1 ul of overnight culture were used for colony PCR in a 20 ul volume:
PCR mix
2.5 ul 10× DyNAzyme buffer
2.5 ul 2 mM dNTPs
1.25 ul M13 F primer (10 uM)
1.25 ul M13R primer (10 uM)
0.25 ul DyNAzyme Polymerase
12.25 ul ddH2O Cycling Conditions:
3 min 94° C.; 1 min 94° C.; 1 min 55° C.; 1 min 72° C. (36 cycles); 10 min 72° C.

Colony PCR amplicon purification and sequencing reads were done using standard protocols. Sequencing primers used were either M13 reverse primer or one of the amplicon specific primers that generated the initial PCR product.

Results

FIGS. 5 to 29 provide matrices produced from bisulfite sequencing data of the gamma amplicon analyzed by the applicant's proprietary software (See WO 2004/000463 for further information). Each column of the matrices represents the sequencing data for a replicate of one sample, all replicates of each sample are grouped together in one block. Each row of a matrix represents a single CpG site within the fragment. The CpG number of the amplificate is shown to the left of the matrices.

The amount of measured methylation at each CpG position is represented by colour from light grey (0% methylation), to medium grey (50% methylation) to dark grey (100% methylation). Some amplificates, samples or CpG positions were not successfully sequenced and these are shown in white.

FIGS. 5 to 29 provide matrices of the bisulfite sequencing data according to Example 5. Each column of the matrices represents the sequencing data for a replicate of one sample, all replicates of each sample are grouped together in one block. Each row of a matrix represents a single CpG site within the fragment. The CpG number of the amplificate is shown to the left of the matrices.

The amount of measured methylation at each CpG position is represented by colour from light grey (0% methylation), to medium grey (50% methylation) to dark grey (100% methylation). Some amplificates, samples or CpG positions were not successfully sequenced and these are shown in white.

FIGS. 5 to 12 provide an overview of the sequencing of the bisulfite converted amplificates of the genomic sequence according to Table 21 in 4 samples that had previously been quantified (by HeavyMethyl assay) as having between 10% and 20% methylation.

FIGS. 13 to 20 provide an overview of the sequencing of the bisulfite converted amplificate of the genomic sequence according to Table 21 in 2 samples that had previously been quantified (by HeavyMethyl assay) as having greater than 20% methylation.

Figure 21:
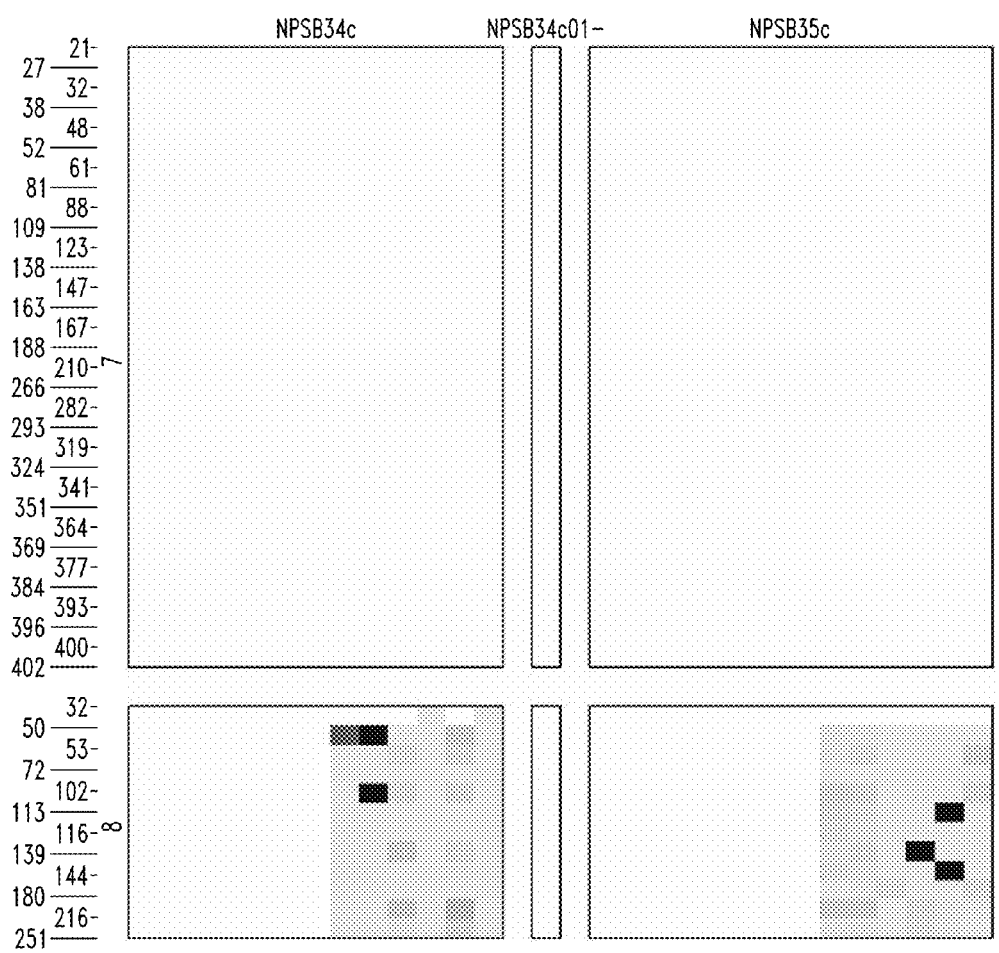
Figure 22:
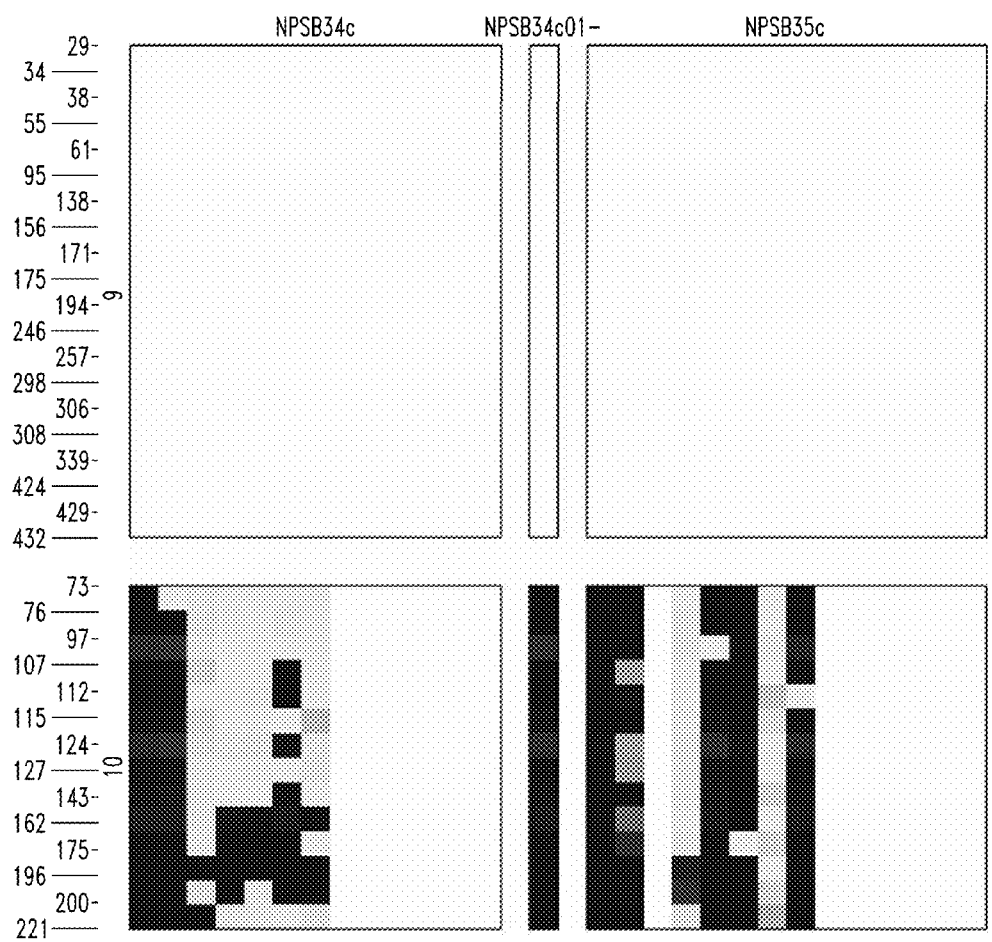
Figure 23:
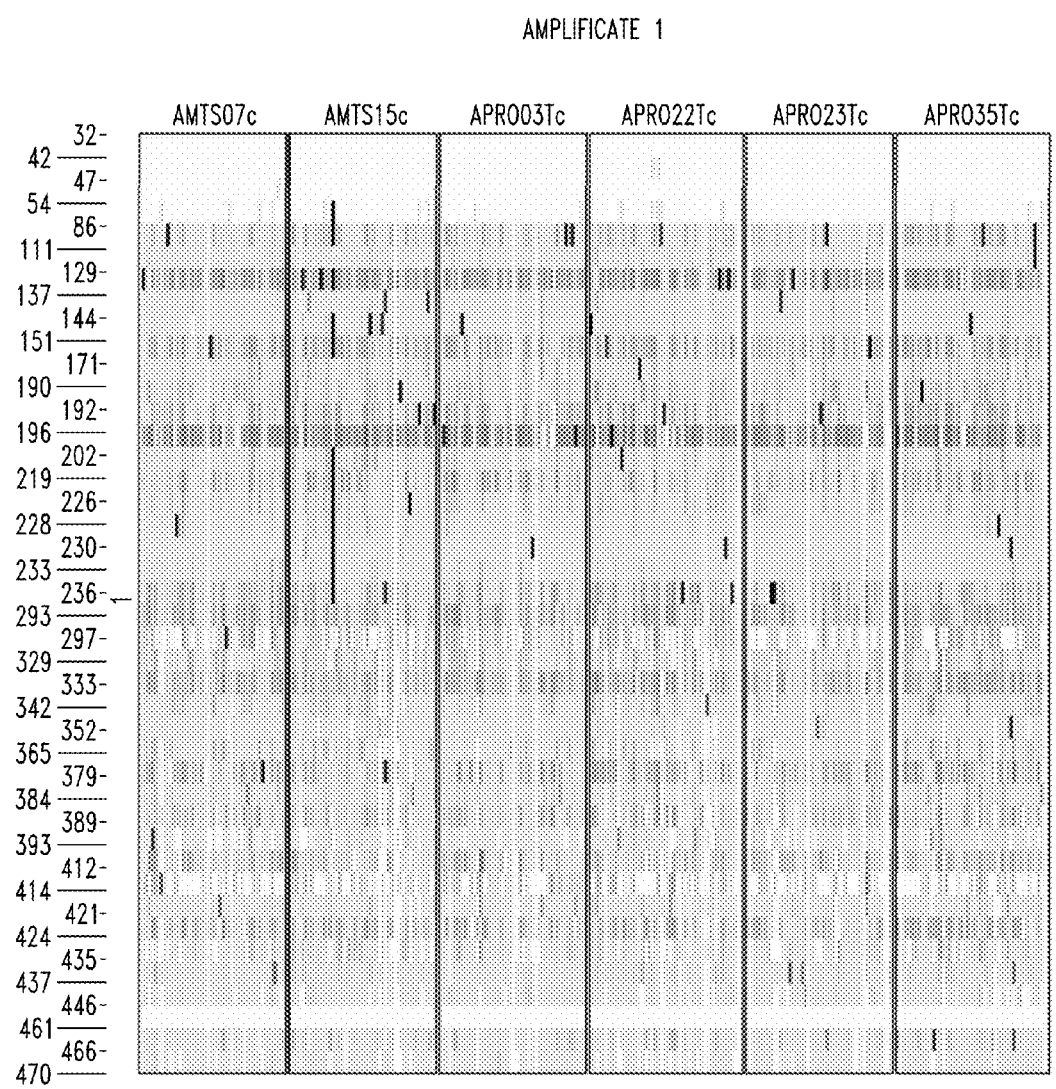
Figure 24:
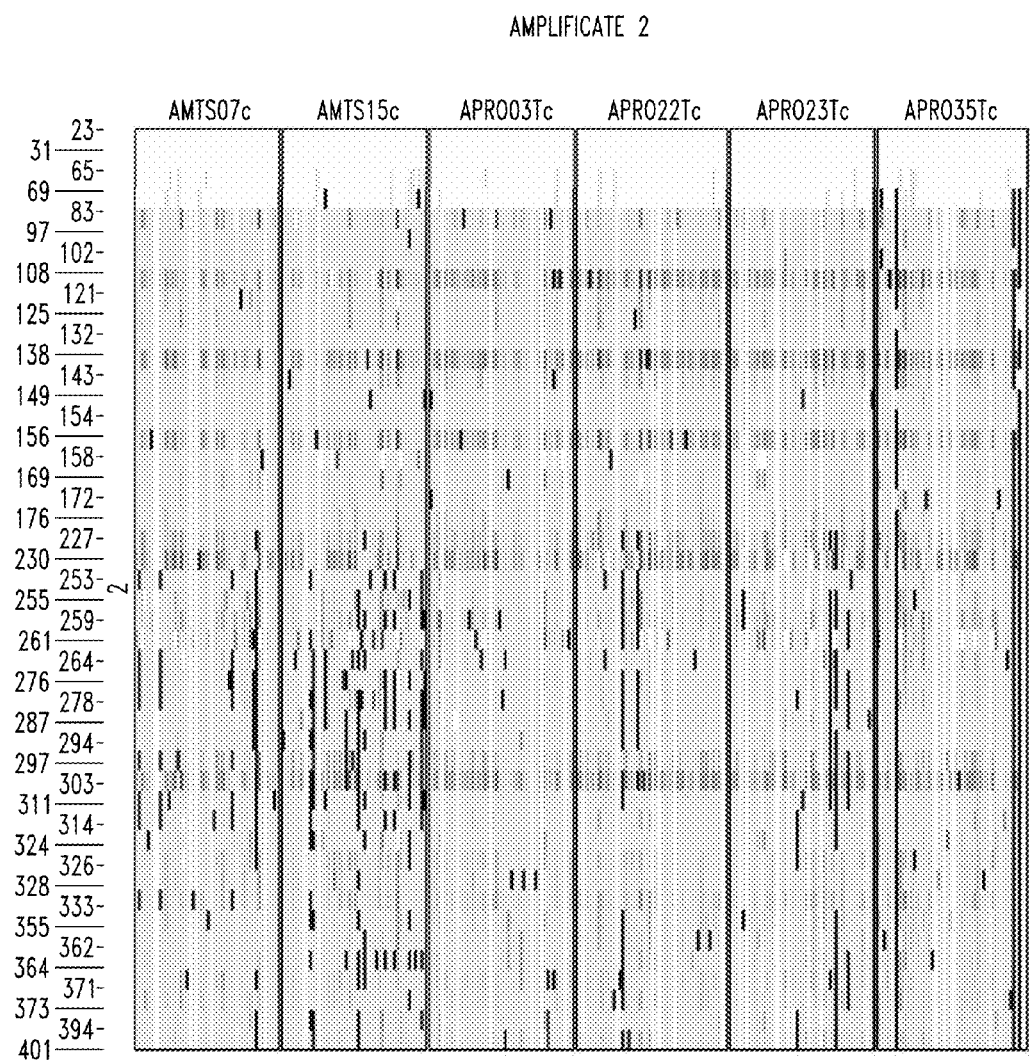
Figure 25:
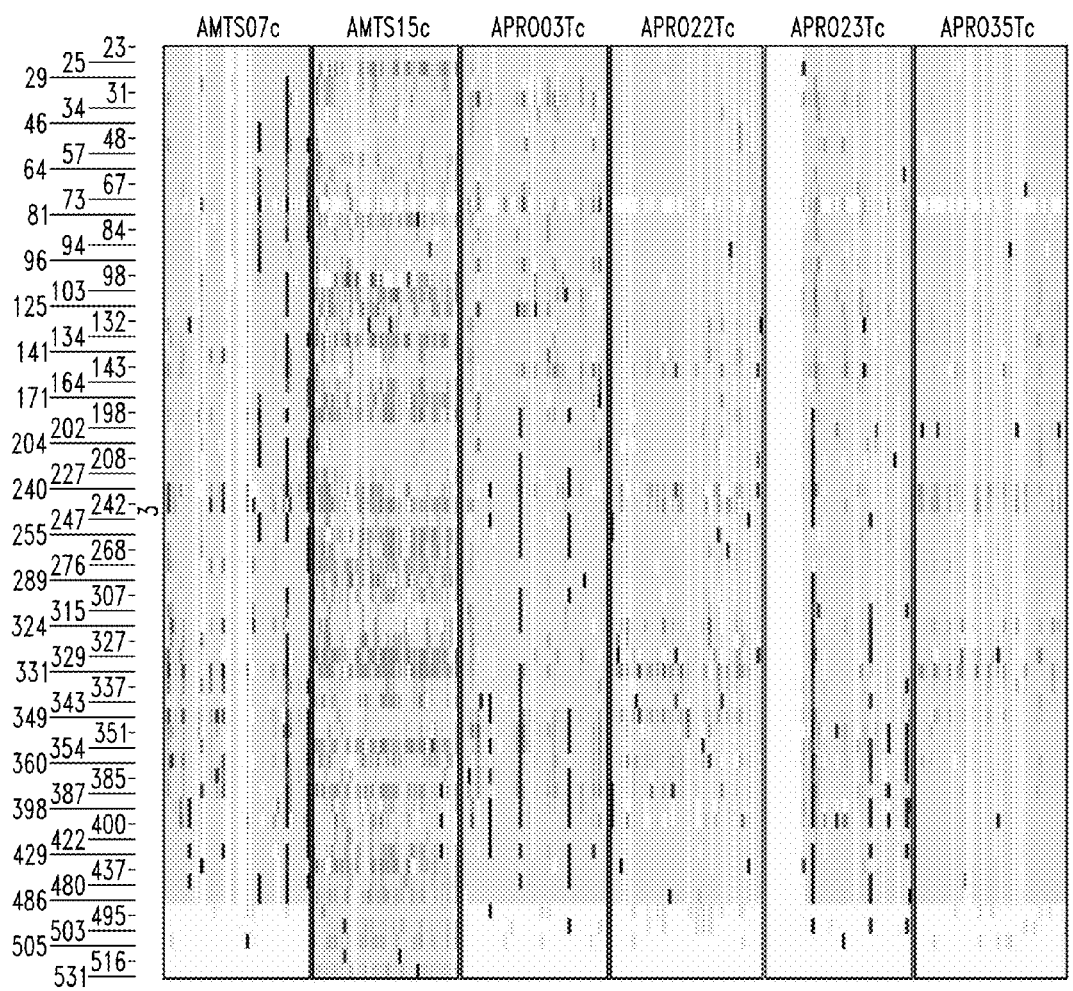
Figure 26:
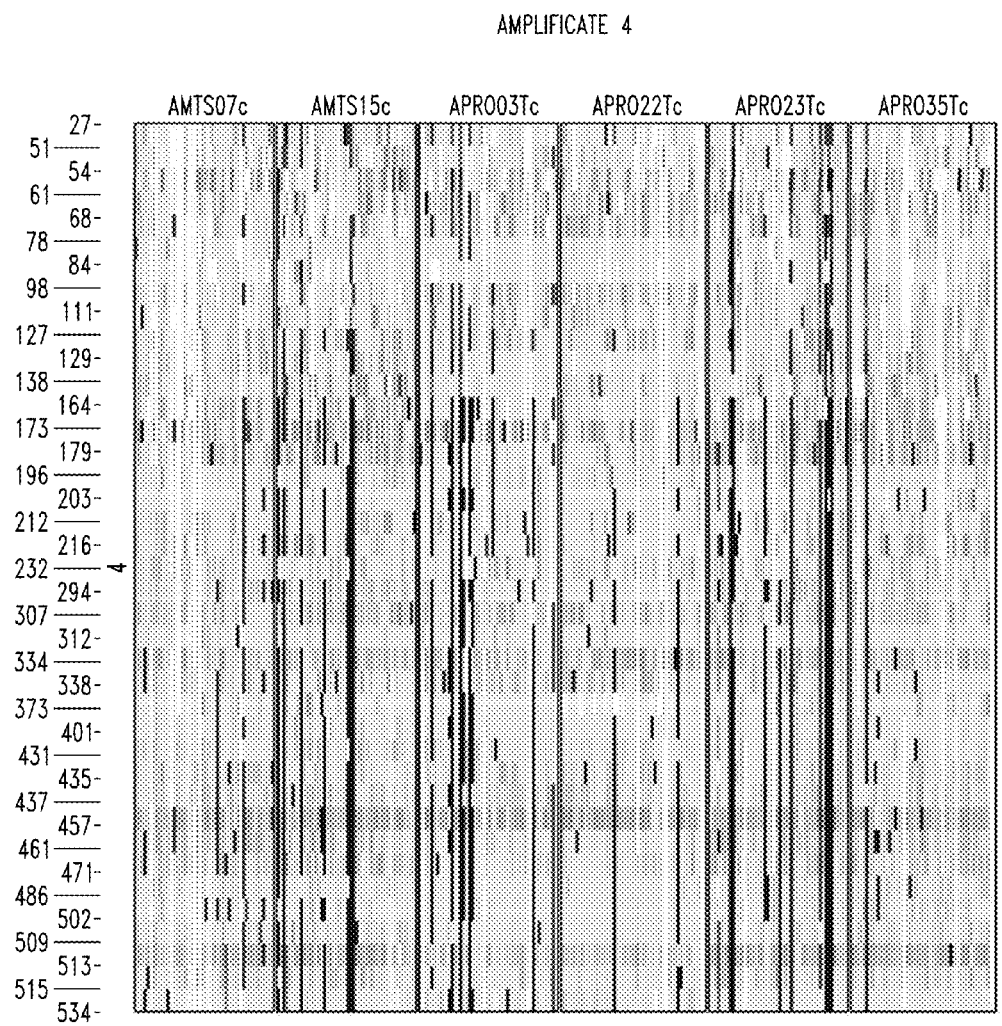
Figure 27:
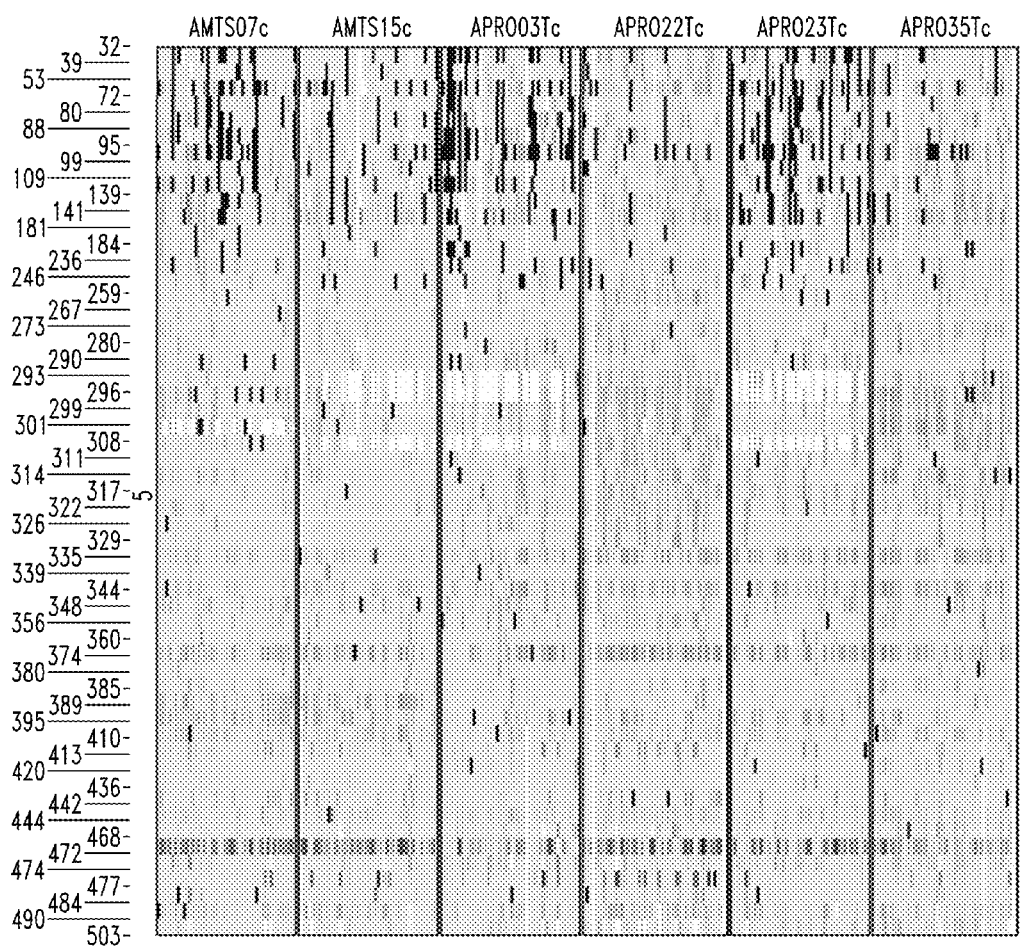
Figure 28:
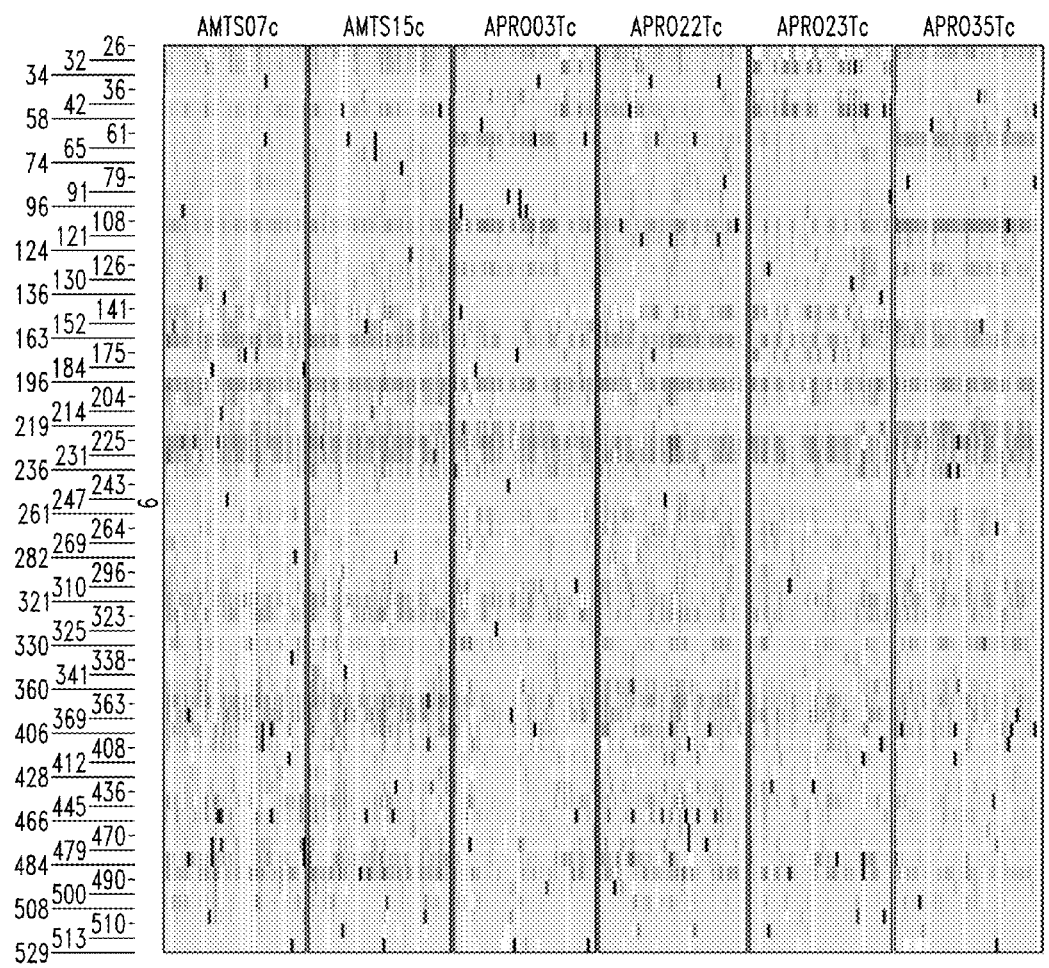
Figure 29:
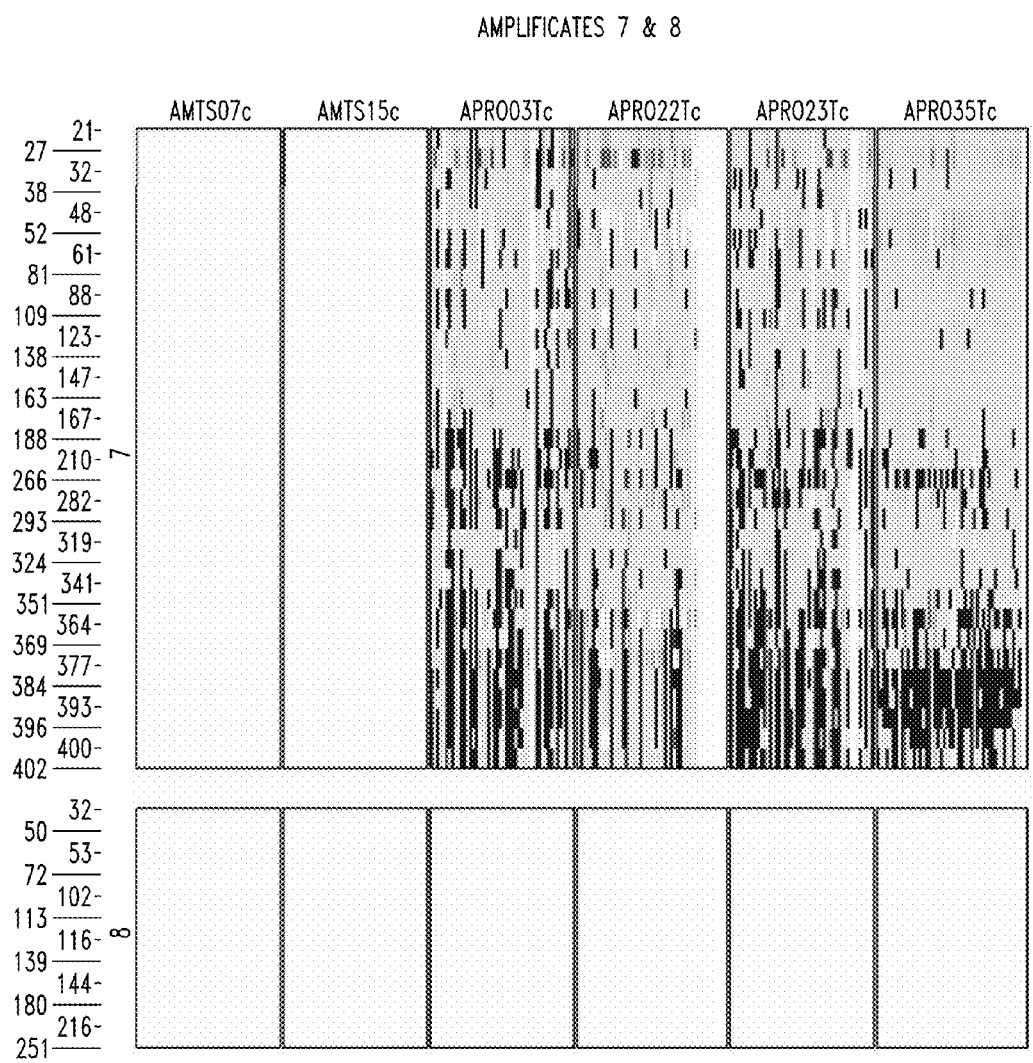
Figure 30:
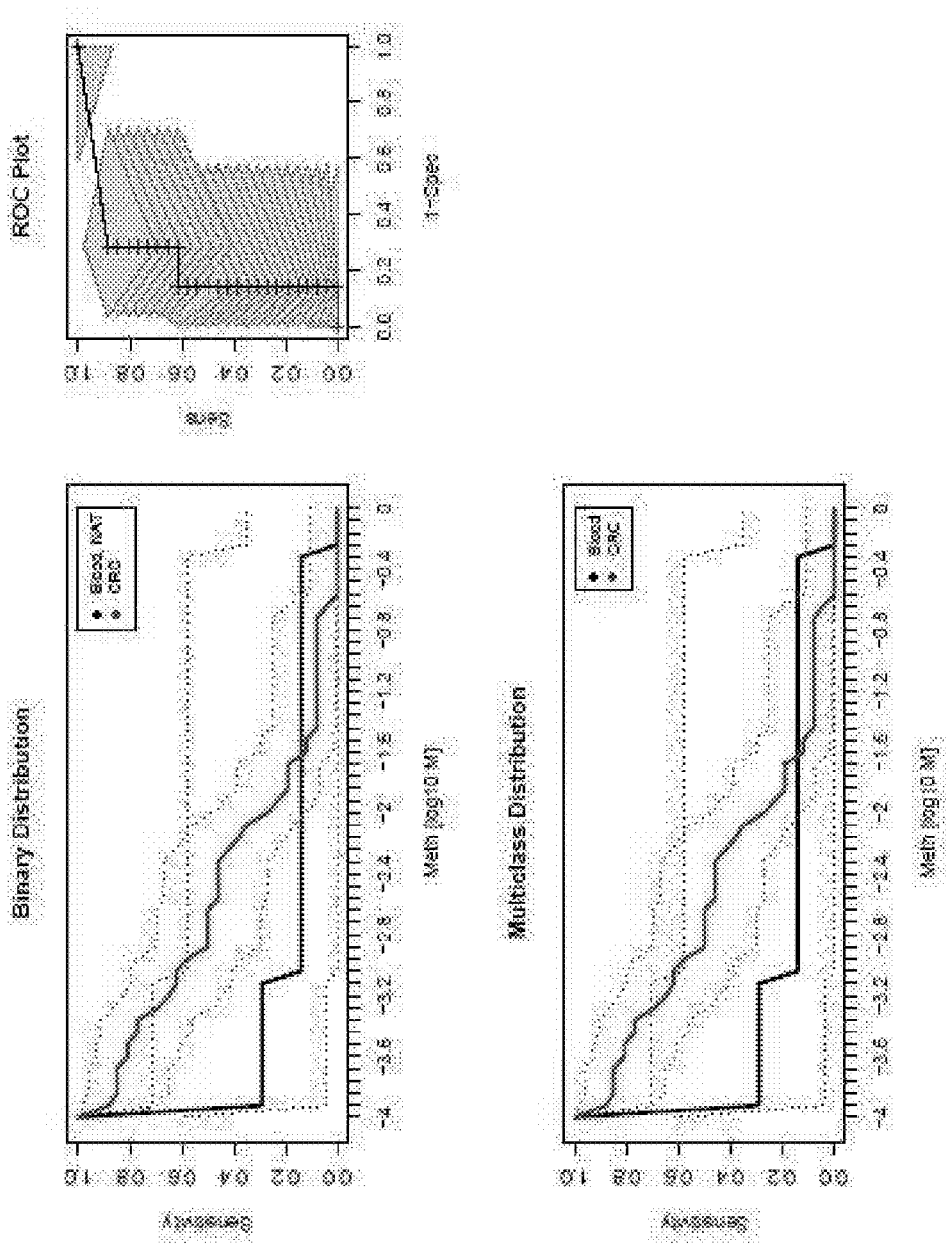
FIGS. 30 to 37 each provide three plots. The two plots on the left show the sensitivity of the assay according to table 12 in colorectal carcinoma and blood samples in Example 2. The upper plot shows a binary distribution of two sample types, whereas the lower plot provides a mulitclass distribution. The Y-Axis of said plots shows the proportion of analysed samples with a methylation level greater than the quantified value shown on the X-axis. The plot to the right provides a ROC of the colorectal carcinoma detection.
Figure 31:
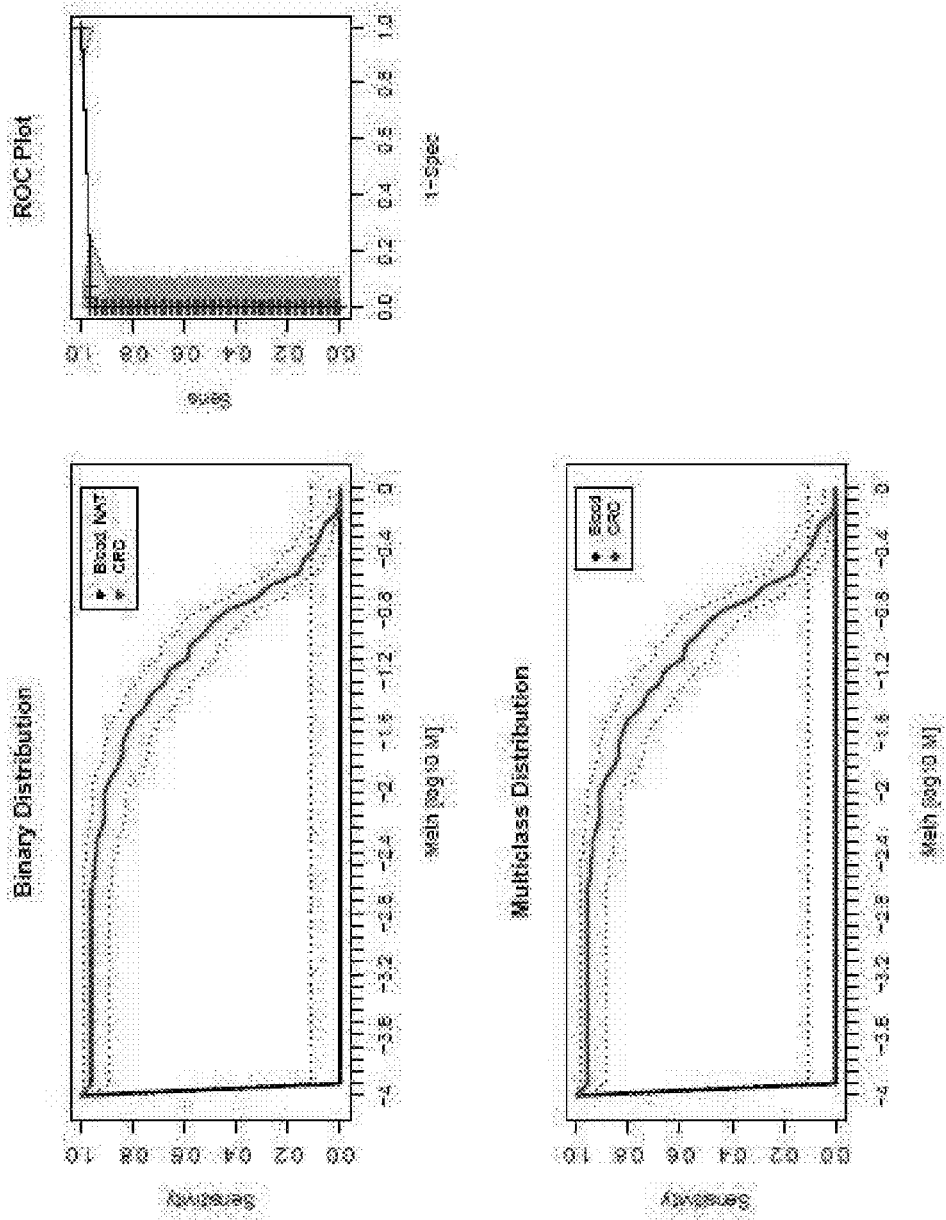
Figure 32:
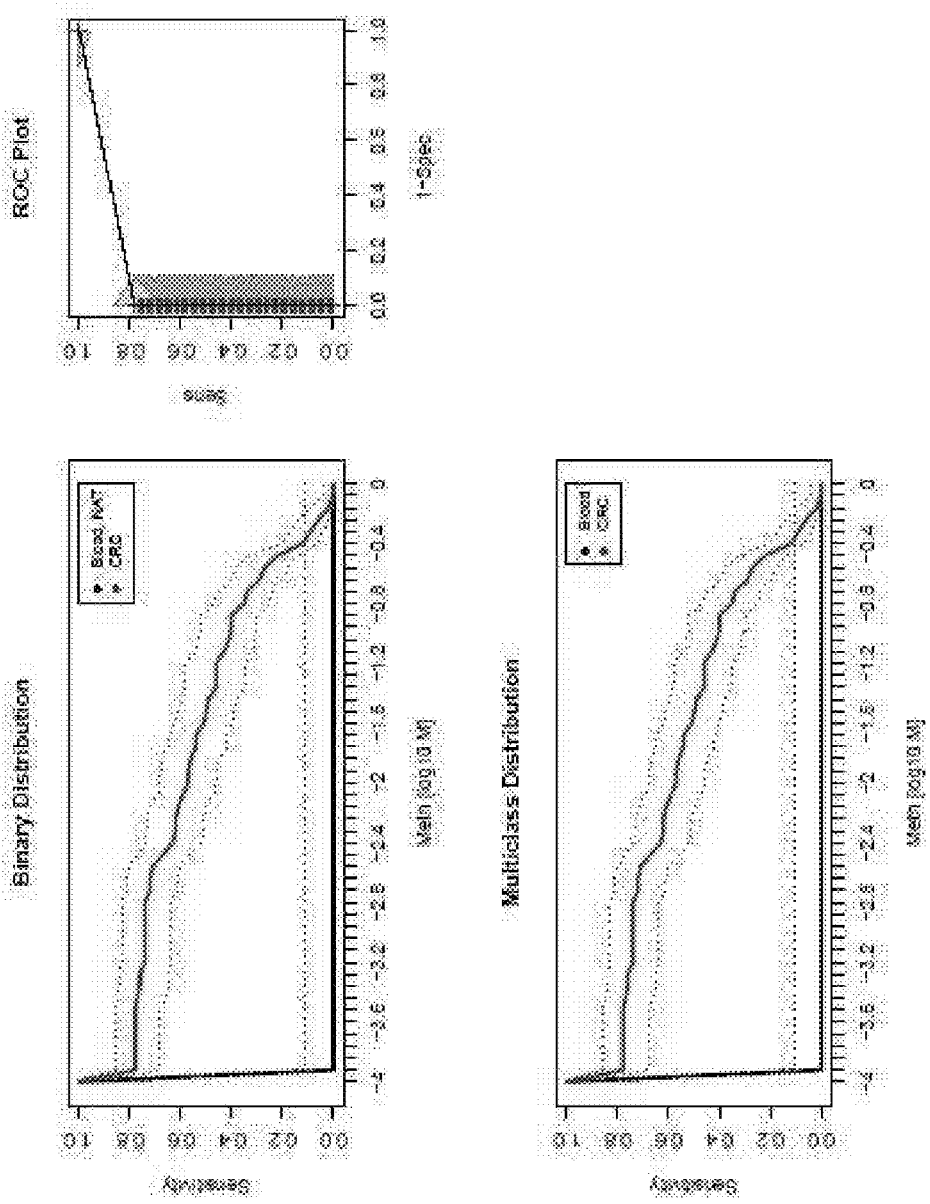
Figure 33:
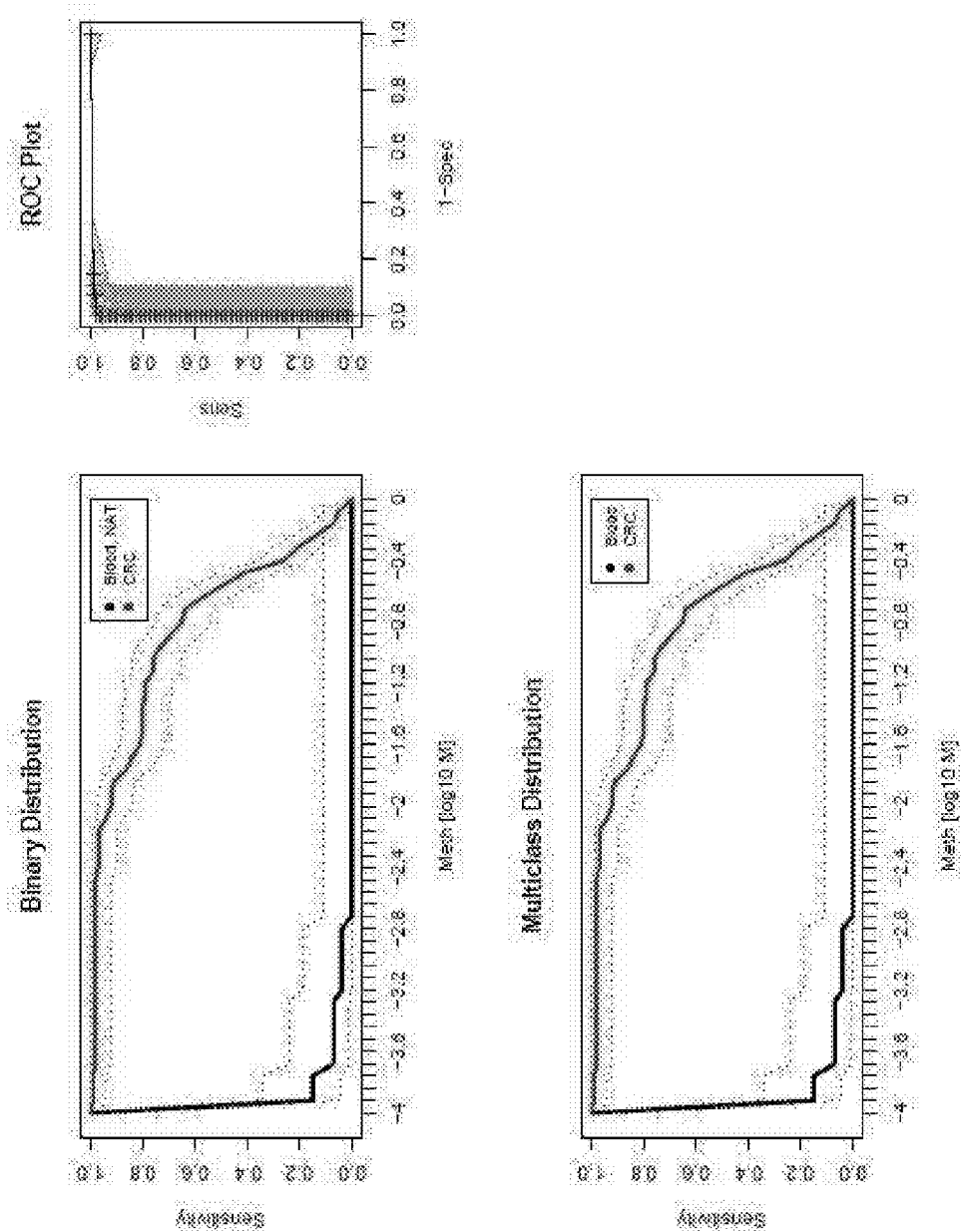
Figure 34:
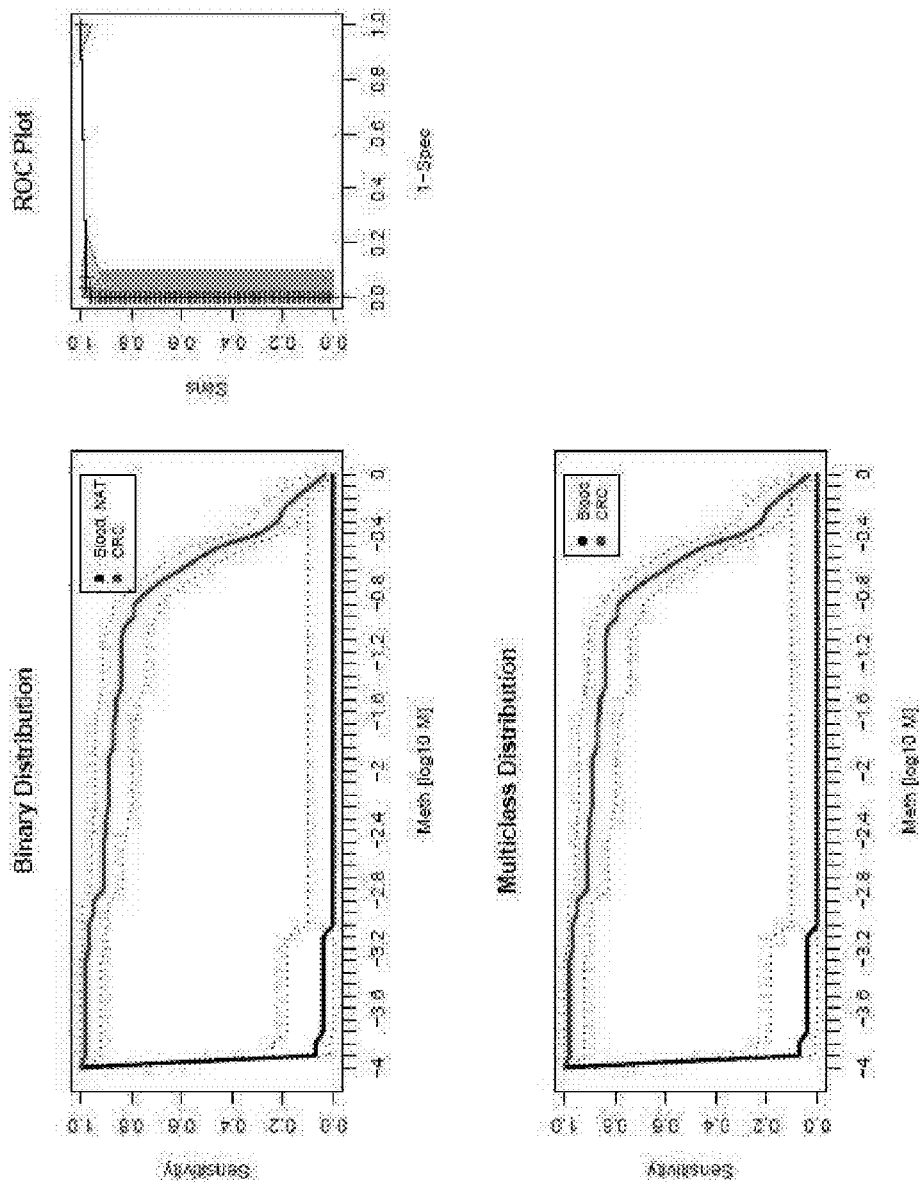
Figure 35:
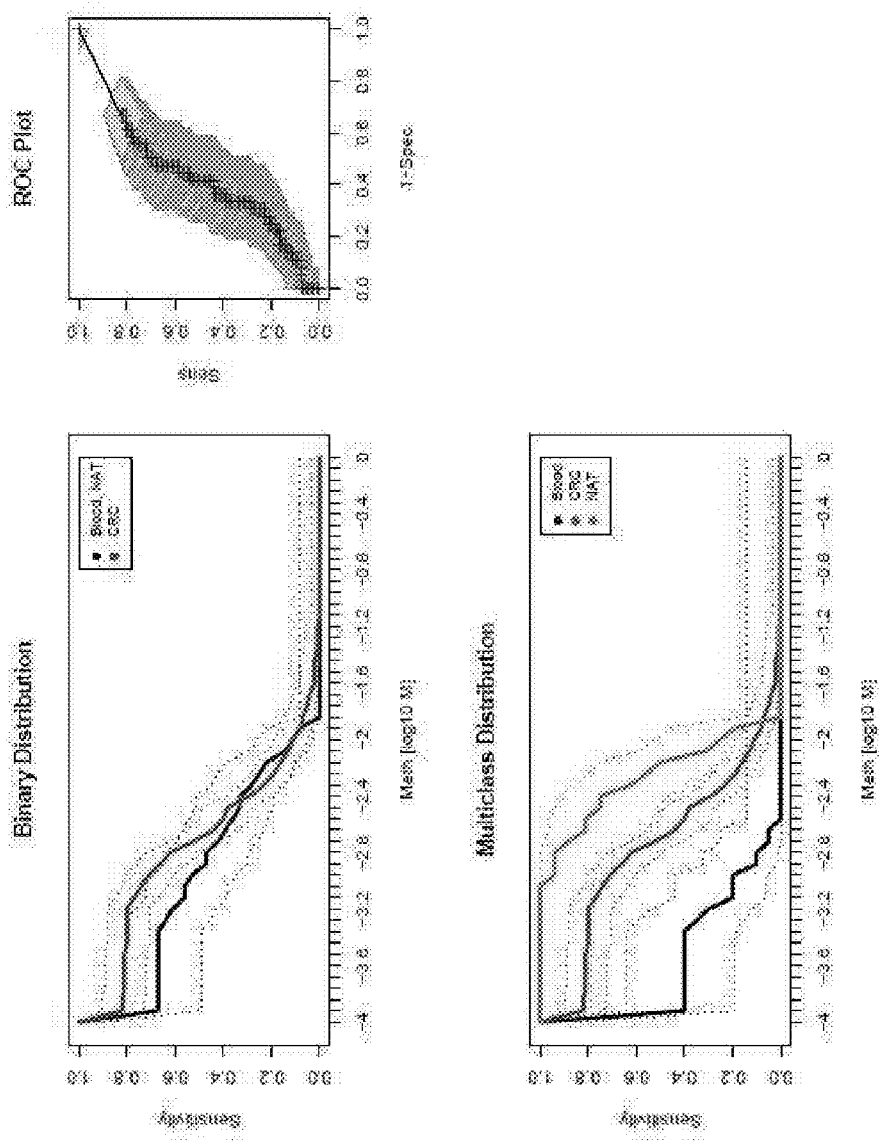
Figure 36:
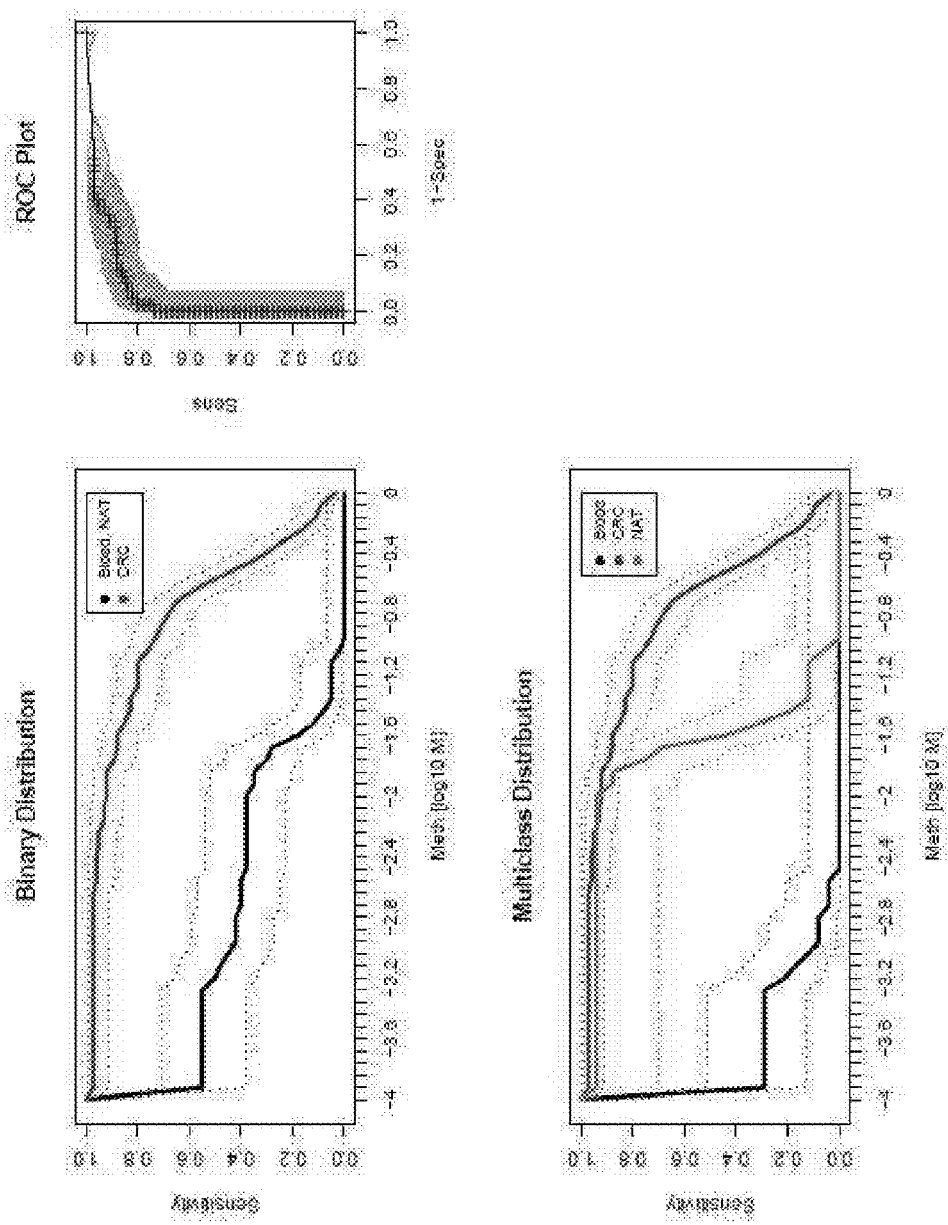
Figure 37:
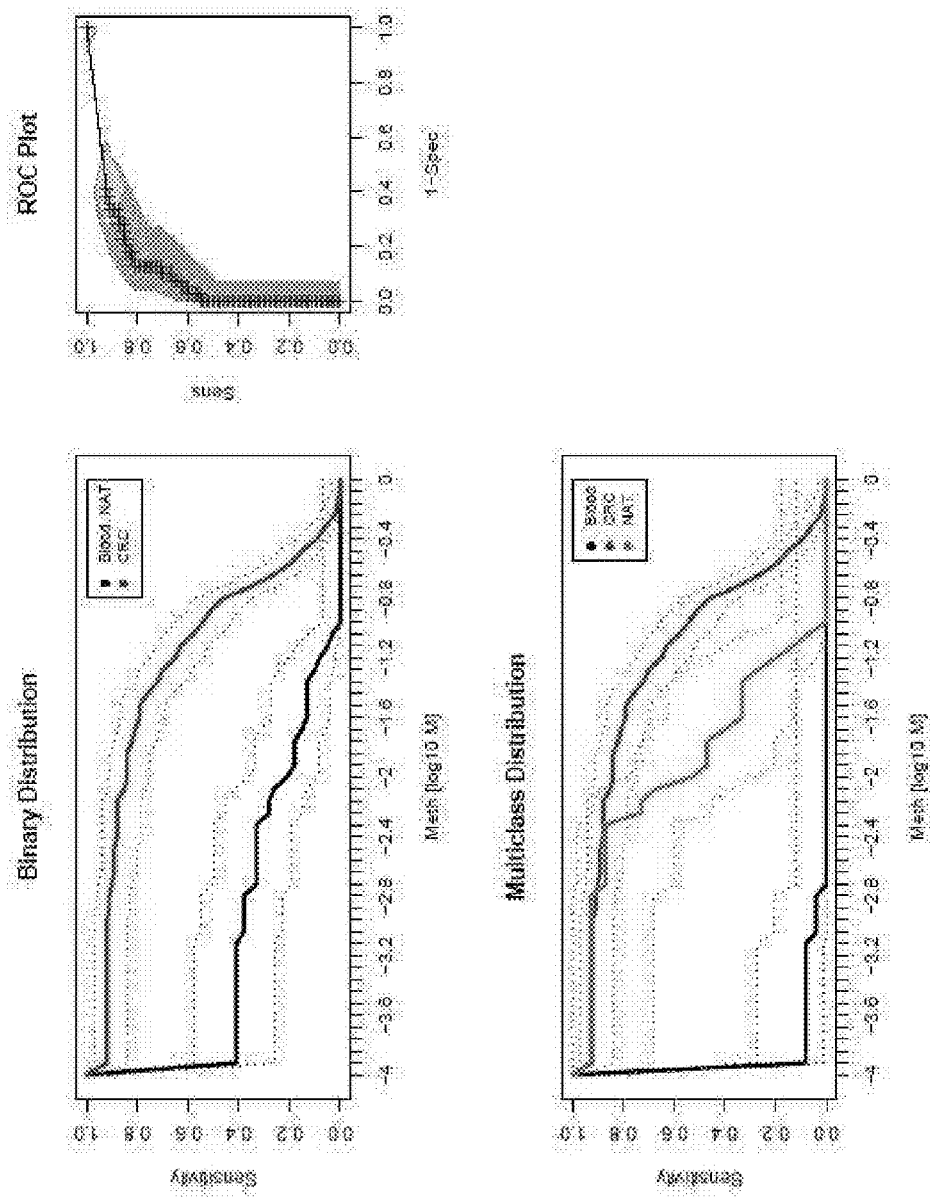

FIGS. 21 to 22 provide an overview of the sequencing of the bisulfite converted amplificate of the genomic sequence according to Table 21 in blood samples from 3 healthy subjects.

FIGS. 23 to 29 provide an overview of the sequencing of the bisulfite converted amplificate of the genomic sequence according to Table 21 in 6 samples that had previously been quantified (by HeavyMethyl assay) as having less than 10% (but greater than 0%) methylation.

Example 6

Further assays suitable for the analysis of bisulfite treated variants of genomic sequences according to SEQ ID NO: 159 to SEQ ID NO: 163 are shown in Table 22. Bisulfite treatment of genomic DNA may be carried out according to protocols known in the art (e.g. Olek A, et al., A modified and improved method for bisulfite based cytosine methylation analysis, *Nucleic Acids Res.* 24:5064-6, 1996). Suitable cycling conditions will be known to one skilled in the art and may be deduced from the melting temperature of the oligomer, as shown in Table 22.

TABLE 1

Genomic sequences according to sequence listing

| SEQ ID NO: | Ensembl database* location | Ensembl datanbase* genomic location | Associated gene transcript(s)* | Methylated bisulfite converted sequence (sense) | Methylated bisulfite converted sequence (antisense) | Unmethylated bisulfite converted sequence (sense) | Unmethylated bisulfite converted sequence (antisense) |
|---|---|---|---|---|---|---|---|
| 1 | AC068594.15.1.168501 150580 to 151086 (+) to AC111170.11.1.158988 137268 to 138151 (+) | 17 72789082 to 73008258 (+) | Septin 9 & Q9HC74 | 4 | 5 | 10 | 11 |
| 2 | AC068594.15.1.168501 150580 to 151255 (+) | 17 72789082 to 72789757 (+) | Septin 9 | 6 | 7 | 12 | 13 |
| 3 | AC111182.20.1.171898 127830 to 129168 (+) | 17 72881422 to 72882760 (+) | Q9HC74 | 8 | 9 | 14 | 15 |
| 24 | AC092947.12.1.72207 58709 to 60723 (+) | 3 140138862 to 140140876 (+) | FOXL2 | 30 | 31 | 42 | 43 |
| 25 | AC015656.9.1.147775 12130 to 12961 (+) | 17 44929475 to 44930306 (−) | NGFR | 32 | 33 | 44 | 45 |
| 26 | AC092644.3.1.171099 148656 to 149604 (+) | 2 192884909 to 192885857 (+) | TMEFF2 | 34 | 35 | 46 | 47 |
| 27 | AL049874.3.1.193047 183 to 2782 (+) | Chr. 14 60045491 to 60048090 (+) | SIX6 | 36 | 37 | 48 | 49 |
| 28 | AC002094.1.1.167101 27574 to 28353 (+) | Chr. 17 23723867 to 23724646 (−) | SARM1 & VTN | 38 | 39 | 50 | 51 |
| 29 | AC007375.6.1.180331: 23232 to 24323 (+) | Chr. 14 76676531 to 76677622 (+) | ZDHHC22 | 40 | 41 | 52 | 53 |
| 159 | AC107050.3.1.167699 73453 to 74793 (+) | 4 188021715 to 188023055 (+) | FAT | 168 | 169 | 186 | 187 |
| 160 | | 18 53498722 to 53498782 (+) | ATP8BI/Q96N33 | 170 | 171 | 188 | 189 |
| 161 | | 20 30533783 to | CT112 | 172 | 173 | 190 | 191 |

TABLE 1-continued

Genomic sequences according to sequence listing

| SEQ ID NO: | Ensembl database* location | Ensembl datanbase* genomic location | Associated gene transcript(s)* | Methylated bisulfite converted sequence (sense) | Methylated bisulfite converted sequence (antisense) | Unmethylated bisulfite converted sequence (sense) | Unmethylated bisulfite converted sequence (antisense) |
|---|---|---|---|---|---|---|---|
| 162 | | 30537106 (+) 4 2384588 to 2389018 (+) | Q726J3/ZFYVE28 | 174 | 175 | 192 | 193 |
| 163 | | 18 46060107 to 46063463 (+) | MBD1/CXXC1 | 176 | 177 | 194 | 195 |
| 164 | | 22 16223947 to 16226116 (+) | Not applicable | 178 | 179 | 196 | 197 |
| 165 | | | PROSTAG LANDIN E2 RECEPTOR | 180 | 181 | 198 | 199 |
| 166 | | | PRDM6 | 182 | 183 | 200 | 201 |
| 167 | | | NR2E1 | 184 | 185 | 202 | 203 |
| 376 | | | ONE CUT DOMAIN FAMILY MEMBER 2; ONC2 | 379 | 380 | 385 | 386 |
| 377 | | | NM_003299 | 381 | 382 | 387 | 388 |
| 378 | | | NM_000484 | 383 | 384 | 390 | 391 |

*Ensembl database

TABLE 2

| Genomic SEQ ID NO: | Assay | Primer | Primer | Blocker | Probe | Probe |
|---|---|---|---|---|---|---|
| SEQ ID NO: 26 (Assay 2) | HM | Gtagtagtagta gggtagagag (SEQ ID NO: 301) | Catccccctaca acctaaa (SEQ ID NO: 302) | Caacctaaaca acacactccac acactaaaacac (SEQ ID NO: 303) | Cgcgggagag ggcgtt (SEQ ID NO: 304) | Tgttggcgatcg gcgtttt (SEQ ID NO: 305) |
| SEQ ID NO: 376 (Assay 2) | MSP | GCGGTTTC GGAGTGGTT (SEQ ID NO: 306) | CCTCCCGA ACCTAAAACGA (SEQ ID NO: 307) | Not applicable | ACGCCCGA CGAACGCCAA (SEQ ID NO: 308) | Not applicable |
| SEQ ID NO: 378 (Assay 21) | MSP | TTTATGTTT TTCGTTTTT CGTTCG (SEQ ID NO: 309) | GAATCCTC ACACCTCC AACCG (SEQ ID NO: 310) | Not applicable | CGCCCACT ACACCGCA AACAAATC (SEQ ID NO: 311) | Not applicable |
| SEQ ID NO: 378 (Assay 1) | MSP | TTACGTGT GAGGGGTTCG (SEQ ID NO: 312) | ACGAAAAT CCACCAAT CGAAAC (SEQ ID NO: 313) | Not applicable | TCCAAATAC GATAACCG ATACCCGA AACG (SEQ ID NO: 314) | Not applicable |
| SEQ ID NO: 163 (Assay 1) | MSP | Ggtattaggtcg gtattttcgt (SEQ ID NO: 315) | Ctattaaaaaca cgcgacatcga (SEQ ID NO: 316) | Not applicable | Tcgttttcgcggtt gttcgttgt (SEQ ID NO: 317) | Ttcggaatcgga agttcgttgtttg (SEQ ID NO: 318) |
| SEQ ID NO: 378 (Assay 1) | MSP | gcgatttcgacgt cggt (SEQ ID NO: 319) | Ctacgttctccgc ctcgtt (SEQ ID NO: 320) | Not applicable | Agggtcgtattta ggttgtcgtcgtta (SEQ ID NO: 321) | Tagtcgcgaaa agaggttggagtaag (SEQ ID NO: 322) |
| SEQ ID NO: 27 (Assay 1) | MSP | Gggtttcgggcg ggta (SEQ ID NO: 323) | Atatcgcactcg ctatcgcta (SEQ ID NO: 324) | Not applicable | gagggcgacgg tacgttagaggt (SEQ ID NO: 325) | ttgggcgtcgttat tagttcggtc (SEQ ID NO: 326) |

TABLE 2-continued

| Genomic SEQ ID NO: | Assay | Primer | Primer | Blocker | Probe | Probe |
|---|---|---|---|---|---|---|
| SEQ ID NO: 27 (Assay 2) | MSP | gtcgggttggag ggacgta (SEQ ID NO: 327) | atatcgcactcg ctatcgcta (SEQ ID NO: 328) | Not applicable | gagggcgacgg tacgttagaggt (SEQ ID NO: 329) | ttgggcgtcgttat tagttcggtc (SEQ ID NO: 330) |
| SEQ ID NO: 28 (Assay 2) | HM | GttTttTtttAttA GTTGGAAGAttT (SEQ ID NO: 331) | aAaCTaCAa CAaaCCTTaTC (SEQ ID NO: 332) | CCTTaTCCA CACTaAAaC AaaCAaaCA aCACACAaaC (SEQ ID NO: 333) | CGtttACGGtt CGCGCG (SEQ ID NO: 334) | CGtTCGttTGt TTtAGCGCG (SEQ ID NO: 335) |
| SEQ ID NO: 26 (Assay 2) | HM | gaggtgttagag gagtagtag (SEQ ID NO: 336) | tccccctacaac ctaaa (SEQ ID NO: 337) | Acctaaacaac acactcccacac actaaaacacc aat (SEQ ID NO: 338) | Cgagtcggcgc ggga (SEQ ID NO: 339) | agggcgttttgttg gcgatc (SEQ ID NO: 340) |
| SEQ ID NO: 26 (Assay 6) | HM | aaaaaaaaaa aactcctctacat ac (SEQ ID NO: 341) | ggttattgtttggg ttaataaatg (SEQ ID NO: 342) | Acatacaccac aaataaattacc aaaaacatcaa ccaa (SEQ ID NO: 343) | ttttttttttcggacg tcgtt (SEQ ID NO: 344) | tcggtcgatgttttt cggtaa (SEQ ID NO: 345) |
| SEQ ID NO: 25 (Assay 3) | HM | tgagagagaga gggttgaaa (SEQ ID NO: 346) | Tctaaataacaa aatacctccatt (SEQ ID NO: 347) | Ccattaccaaca caacccaccaa ccaa (SEQ ID NO: 348) | CGaccCGcca acCGac (SEQ ID NO: 349) | CGcCGaaaC GCGctc (SEQ ID NO: 350) |
| SEQ ID NO: 165 (Assay 1) | HM | Tggttattaattat gtttattttttatag (SEQ ID NO: 351) | Accaaatatcta aatactacaacc (SEQ ID NO: 352) | Tacaaccacaa actaccaaaac ccatattaaaca acacac (SEQ ID NO: 353) | tatgcgtttaacgt gttttttttgcg (SEQ ID NO: 354) | tggcgggttttac gtttttttgtagt (SEQ ID NO: 355) |
| SEQ ID NO: 1 (Assay 7) | HM | GtAGtAGttA GttttAGtAtttAtt TT (SEQ ID NO: 356) | CCCACCAa CCATCATaT (SEQ ID NO: 357) | CATCATaTC AaACCCCA CAaTCAACA CACAaC (SEQ ID NO: 358) | GaACCCCG CGaTCAAC GCG (SEQ ID NO: 359) | Not applicable |
| SEQ ID NO: 1 (Assay 7) | HM | GtAGtAGttA GttttAGtAtttAtt TT (SEQ ID NO: 360) | CCCACCAa CCATCATaT (SEQ ID NO: 361) | CATCATaTC AaACCCCA CAaTCAACA CACAaC (SEQ ID NO: 362) | GTtCGAAAT GATttTATttA GtTGC (SEQ ID NO: 14844363) | CGTTGAtCG CGGGGTtC (SEQ ID NO: 364) |
| SEQ ID NO: 24 (Assay 5) | HM | ccaaaacctaa acttacaac (SEQ ID NO: 365) | Ggaaatttgagg ggtaa (SEQ ID NO: 366) | Tacaacaccac caacaaaccca aaaacacaa (SEQ ID NO: 367) | GTtAATTGC GGGCGAtC GA (SEQ ID NO: 368) | CGtCGttAGC GGGTGGG (SEQ ID NO: 369) |
| SEQ ID NO: 28 (Assay 1) | MSP | cggttgttgtagg cgtc (SEQ ID NO: 370) | gcaaaacacac gaaaacg (SEQ ID NO: 371) | Not applicable | Cgcgtgtgtagg tcgcgcgt (SEQ ID NO: 372) | Not applicable |
| SEQ ID NO: 1 (Assay 2) | MSP | aaaatcctctcc aacacgtc (SEQ ID NO: 373) | cgcgattcgttgtt tattag (SEQ ID NO: 374) | Not applicable | CGgatttCGC GgttaaCGCG tagtt (SEQ ID NO: 375) | Not applicable |

TABLE 3

Samples analysed according to Example 2

| Assay | Total no samples | Colorectal carcinoma | Normal adjacent tissue | Blood |
|---|---|---|---|---|
| SEQ ID NO: 165 (Assay 1) | 33 | 26 | 0 | 7 |
| SEQ ID NO: 24 (Assay 5) | 106 | 79 | 0 | 27 |
| SEQ ID NO: 25 (Assay 3) | 109 | 82 | 0 | 27 |
| SEQ ID NO: 26 (Assay 6) | 113 | 86 | 0 | 27 |
| SEQ ID NO: 1 (Assay 2) | 115 | 87 | 0 | 28 |
| MSP SEQ ID NO: 376 (Assay 2) | 127 | 91 | 16 | 20 |

TABLE 3-continued

Samples analysed according to Example 2

| Assay | Total no samples | Colorectal carcinoma | Normal adjacent tissue | Blood |
|---|---|---|---|---|
| SEQ ID NO: 378 (Assay 1) | 118 | 78 | 16 | 24 |
| SEQ ID NO: 378 (Assay 21) | 118 | 78 | 16 | 24 |
| SEQ ID NO: 378 (Assay 1) | 118 | 78 | 16 | 24 |
| SEQ ID NO: 163 (Assay 1) | 118 | 78 | 16 | 24 |
| SEQ ID NO: 26 (Assay 2) HM | 132 | 92 | 16 | 24 |
| MSP SEQ ID NO: 27 (Assay 2) | 128 | 89 | 15 | 24 |

TABLE 4

Proportion of colorectal carcinoma samples with methylation within various thresholds

| Assay | above 0.01 | above 0.1 | above 0.3 | above 0.5 |
|---|---|---|---|---|
| SEQ ID NO: 165 (Assay 1) | 0.269 | 0.077 | 0 | 0 |
| SEQ ID NO: 24 (Assay 5) | 0.911 | 0.557 | 0.152 | 0.076 |
| SEQ ID NO: 25 (Assay 3) | 0.573 | 0.402 | 0.232 | 0.073 |
| SEQ ID NO: 26 (Assay 6) | 0.919 | 0.756 | 0.43 | 0.186 |
| SEQ ID NO: 1 (Assay 2) | 0.885 | 0.816 | 0.506 | 0.218 |
| MSP SEQ ID NO: 376 (Assay 2) | 0.11 | 0 | 0 | 0 |
| SEQ ID NO: 378 (Assay 1) | 0 | 0 | 0 | 0 |
| SEQ ID NO: 378 (Assay 21) | 0 | 0 | 0 | 0 |
| SEQ ID NO: 378 (Assay 1) | 0 | 0 | 0 | 0 |
| SEQ ID NO: 163 (Assay 1) | 0 | 0 | 0 | 0 |
| SEQ ID NO: 26 (Assay 2) HM | 0.924 | 0.739 | 0.446 | 0.228 |
| MSP SEQ ID NO: 27 (Assay 2) | 0.843 | 0.551 | 0.169 | 0.056 |

TABLE 5

Proportion of normal adjacent tissue samples with methylation within various thresholds

| Assay | above 0.001 | above 0.01 | above 0.1 | above 0.3 |
|---|---|---|---|---|
| MSP SEQ ID NO: 376 (Assay 2) | 0.938 | 0.25 | 0 | 0 |
| SEQ ID NO: 378 (Assay 1) | 0 | 0 | 0 | 0 |
| SEQ ID NO: 378 (Assay 21) | 0 | 0 | 0 | 0 |
| SEQ ID NO: 378 (Assay 1) | 0.25 | 0 | 0 | 0 |
| SEQ ID NO: 163 (Assay 1) | 0 | 0 | 0 | 0 |
| SEQ ID NO: 26 (Assay 2) HM | 0.938 | 0.938 | 0 | 0 |
| MSP SEQ ID NO: 27 (Assay 2) | 0.933 | 0.533 | 0.067 | 0 |

TABLE 6

Proportion of whole blood samples with methylation within various thresholds

| Assay | above 0.0001 | above 0.001 | Above 0.01 | above 0.1 |
|---|---|---|---|---|
| SEQ ID NO: 165 (Assay 1) | 0.286 | 0.143 | 0.143 | 0.143 |
| SEQ ID NO: 24 (Assay 5) | 0.074 | 0 | 0 | 0 |
| SEQ ID NO: 25 (Assay 3) | 0 | 0 | 0 | 0 |
| SEQ ID NO: 26 (Assay 6) | 0.148 | 0.037 | 0 | 0 |
| SEQ ID NO: 1 (Assay 2) | 0.071 | 0 | 0 | 0 |
| MSP SEQ ID NO: 376 (Assay 2) | 0.4 | 0.2 | 0 | 0 |
| SEQ ID NO: 378 (Assay 1) | 0 | 0 | 0 | 0 |
| SEQ ID NO: 378 (Assay 21) | 0 | 0 | 0 | 0 |
| SEQ ID NO: 378 (Assay 1) | 0 | 0 | 0 | 0 |
| SEQ ID NO: 163 (Assay 1) | 0 | 0 | 0 | 0 |
| SEQ ID NO: 26 (Assay 2) HM | 0.292 | 0.083 | 0 | 0 |
| SEQ ID NO: 27 (Assay 2 MSP) | 0.083 | 0.042 | 0 | 0 |

TABLE 7

Proportion of colorectal carcinoma samples within various methylation thresholds according to stage of disease

| Assay | Stage I | | Stage II | | Stage III | | Stage IV | |
|---|---|---|---|---|---|---|---|---|
| | >10% | >20% | >10% | >20% | >10% | >20% | >10% | >20% |
| SEQ ID NO: 24 (Assay 5 HM) | 38.5 | 23.1 | 90 | 60 | 53.8 | 23.1 | 57.1 | 42.9 |
| SEQ ID NO: 25 (Assay 3) | 53.8 | 46.2 | 50 | 40 | 44.4 | 37 | 12.5 | 12.5 |
| SEQ ID NO: 26 (Assay 6) | 64.3 | 64.3 | 90 | 70 | 86.2 | 62.1 | 66.7 | 66.7 |
| SEQ ID NO: 1 (Assay 2 MSP) | 71.4 | 64.3 | 100 | 80 | 79.3 | 58.6 | 88.9 | 88.9 |
| SEQ ID NO: 26 (Assay 2) | 66.7 | 66.7 | 92.3 | 76.9 | 75 | 53.6 | 72.7 | 72.7 |
| SEQ ID NO: 27 (Assay 2) | 55.6 | 33.3 | 69.2 | 38.5 | 44.4 | 18.5 | 80 | 50 |

TABLE 8

Proportion of colorectalcarcinoma samples detected within thresholds 1% to 10% methylation

| Panel | N samples | 1% methylation | 1% methylation gain | 5% methylation | 5% methylation gain | 10% methylation | 10% methylation gain |
|---|---|---|---|---|---|---|---|
| SEQ ID NO: 24 (Assay 5)/SEQ ID NO: 25 (Assay 3) | 73 | 0.917808219 | 0.006415814 | 0.767123288 | 0.070920756 | 0.643835616 | 0.086873591 |
| SEQ ID NO: 24 (Assay 5)/SEQ ID NO: 26 (Assay 6) | 78 | 0.961538462 | 0.04293381 | 0.833333333 | 0.042635659 | 0.794871795 | 0.039057841 |
| SEQ ID NO: 24 (Assay 5)/SEQ ID NO: 1 (Assay 2) | 78 | 0.987179487 | 0.075787082 | 0.884615385 | 0.045534925 | 0.884615385 | 0.068523431 |
| SEQ ID NO: 24 (Assay 5)/SEQ ID NO: 26 (Assay 2 HM) | 72 | 0.986111111 | 0.062198068 | 0.847222222 | 0.042874396 | 0.805555556 | 0.066425121 |
| SEQ ID NO: 24 (Assay 5)/MSP SEQ ID NO: 27(Assay 2) | 69 | 0.956521739 | 0.045129334 | 0.855072464 | 0.15844325 | 0.710144928 | 0.153182902 |
| SEQ ID NO: 25 (Assay 3)/SEQ ID NO: 26 (Assay 6) | 80 | 0.9125 | 0.006104651 | 0.8 | 0.009302326 | 0.7625 | 0.006686047 |
| SEQ ID NO: 25 (Assay 3)/SEQ ID NO: 1 (Assay 2) | 81 | 0.938271605 | 0.053214134 | 0.901234568 | 0.062154108 | 0.888888889 | 0.072796935 |
| SEQ ID NO: 25 (Assay 3)/SEQ ID NO: 26 (Assay 2 HM) | 74 | 0.945945946 | 0.022032902 | 0.837837838 | 0.033490012 | 0.797297297 | 0.058166863 |
| SEQ ID NO: 25 (Assay 3)/MSP SEQ ID NO: 27 (Assay 2) | 72 | 0.916666667 | 0.073970037 | 0.791666667 | 0.095037453 | 0.680555556 | 0.129993758 |
| SEQ ID NO: 26 (Assay 6)/SEQ ID NO: 1 (Assay 2) | 85 | 0.976470588 | 0.057865937 | 0.894117647 | 0.055037187 | 0.882352941 | 0.066260987 |
| SEQ ID NO: 26 (Assay 6)/SEQ ID NO: 26 (Assay 2 HM) | 78 | 0.974358974 | 0.050445931 | 0.871794872 | 0.067447046 | 0.833333333 | 0.07751938 |
| SEQ ID NO: 26 (Assay 6)/ MSP SEQ ID NO: 27.2) | 75 | 1 | 0.081395349 | 0.893333333 | 0.102635659 | 0.853333333 | 0.09751938 |
| SEQ ID NO: 1 (Assay 2)/ SEQ ID NO: 26 (Assay 2 HM) | 79 | 0.974683544 | 0.050770501 | 0.898734177 | 0.059653717 | 0.886075949 | 0.069983995 |
| SEQ ID NO: 1 (Assay 2)/MSP SEQ ID NO: 27 (Assay 2) | 76 | 0.960526316 | 0.075468845 | 0.921052632 | 0.081972172 | 0.881578947 | 0.065486993 |
| SEQ ID NO: 26.2 HM)/MSP SEQ ID NO: 27 (Assay 2) | 87 | 0.954022989 | 0.030109945 | 0.850574713 | 0.046226887 | 0.793103448 | 0.053973013 |

TABLE 9

Proportion of colorectalcarcinoma samples detected within thresholds 15% to 25% methylation

| Panel | N samples | 15% methylation | 15% methylation gain | 20% methylation | 20% methylation gain | 25% methylation | 25% methylation gain |
|---|---|---|---|---|---|---|---|
| SEQ ID NO: 24 (Assay 5)/SEQ ID NO: 25 (Assay 3) | 73 | 0.589041096 | 0.146003121 | 0.493150685 | 0.163882392 | 0.410958904 | 0.130471099 |
| SEQ ID NO: 24 (Assay 5)/SEQ ID NO: 26 (Assay 6) | 78 | 0.730769231 | 0.07960644 | 0.679487179 | 0.051580203 | 0.58974359 | 0.043231962 |
| SEQ ID NO: 24 (Assay 5)/SEQ ID NO: 1 (Assay 2) | 78 | 0.820512821 | 0.061892131 | 0.717948718 | 0.039787798 | 0.602564103 | 0.027851459 |
| SEQ ID NO: 24 (Assay 5)/SEQ ID NO: 26 (Assay 2 HM) | 72 | 0.75 | 0.065217391 | 0.666666667 | 0.036231884 | 0.583333333 | 0.050724638 |
| SEQ ID NO: 24 (Assay 5)/MSP SEQ ID NO: 27 (Assay 2) | 69 | 0.652173913 | 0.180263801 | 0.492753623 | 0.176297927 | 0.362318841 | 0.134470739 |
| SEQ ID NO: 25 (Assay 3)/SEQ ID NO: 26 (Assay 6) | 80 | 0.6875 | 0.036337209 | 0.6625 | 0.034593023 | 0.575 | 0.028488372 |
| SEQ ID NO: 25 (Assay 3)/SEQ ID NO: 1 (Assay 2) | 81 | 0.839506173 | 0.080885483 | 0.740740741 | 0.062579821 | 0.62962963 | 0.054916986 |
| SEQ ID NO: 25 (Assay 3)/SEQ ID NO: 26 (Assay 2 HM) | 74 | 0.743243243 | 0.058460635 | 0.702702703 | 0.07226792 | 0.594594595 | 0.061985899 |
| SEQ ID NO: 25 (Assay 3)/MSP SEQ ID NO: 27(Assay 2) | 72 | 0.611111111 | 0.139200999 | 0.5 | 0.170731707 | 0.402777778 | 0.122289973 |
| SEQ ID NO: 26 (Assay 6)/SEQ ID NO: 1 (Assay 2) | 85 | 0.835294118 | 0.076673428 | 0.776470588 | 0.098309669 | 0.729411765 | 0.154699121 |
| SEQ ID NO: 26 (Assay 6)/SEQ ID NO: 26 (Assay 2 HM) | 78 | 0.756410256 | 0.071627648 | 0.730769231 | 0.100334448 | 0.653846154 | 0.107334526 |
| SEQ ID NO: 26 (Assay 6)/ MSP SEQ ID NO: 27.2) | 75 | 0.72 | 0.068837209 | 0.693333333 | 0.065426357 | 0.586666667 | 0.040155039 |
| SEQ ID NO: 1 (Assay 2)/ SEQ ID NO: 26 (Assay 2 HM) | 79 | 0.835443038 | 0.076822348 | 0.797468354 | 0.119307435 | 0.696202532 | 0.121489888 |
| SEQ ID NO: 1 (Assay 2)/MSP SEQ ID NO: 27 (Assay 2) | 76 | 0.815789474 | 0.057168784 | 0.684210526 | 0.006049607 | 0.605263158 | 0.030550514 |
| SEQ ID NO: 26.2 HM)/MSP SEQ ID NO: 27 (Assay 2) | 87 | 0.954022989 | 0.030109945 | 0.850574713 | 0.046226887 | 0.793103448 | 0.053973013 |

TABLE 10

Proportion of colorectalcarcinoma samples detected within thresholds 30% to 50% methylation

| Panel | N samples | 30% methylation | 30% methylation gain | 50% methylation |
|---|---|---|---|---|
| SEQ ID NO: 24 (Assay 5)/SEQ ID NO: 25 (Assay 3) | 73 | 0.315068493 | 0.083361176 | 0.123287671 |
| SEQ ID NO: 24 (Assay 5)/SEQ ID NO: 26 (Assay 6) | 78 | 0.474358974 | 0.044126416 | 0.217948718 |
| SEQ ID NO: 24 (Assay 5)/SEQ ID NO: 1 (Assay 2) | 78 | 0.538461538 | 0.032714412 | 0.269230769 |
| SEQ ID NO: 24 (Assay 5)/SEQ ID NO: 26 (Assay 2 HM) | 72 | 0.486111111 | 0.040458937 | 0.263888889 |
| SEQ ID NO: 24 (Assay 5)/MSP SEQ ID NO: 27 (Assay 2) | 69 | 0.260869565 | 0.092330239 | 0.115942029 |
| SEQ ID NO: 25 (Assay 3)/SEQ ID NO: 26 (Assay 6) | 80 | 0.475 | 0.044767442 | 0.2 |
| SEQ ID NO: 25 (Assay 3)/SEQ ID NO: 1 (Assay 2) | 81 | 0.580246914 | 0.074499787 | 0.259259259 |
| SEQ ID NO: 25 (Assay 3)/SEQ ID NO: 26 (Assay 2 HM) | 74 | 0.5 | 0.054347826 | 0.243243243 |
| SEQ ID NO: 25 (Assay 3)/MSP SEQ ID NO: 27 (Assay 2) | 72 | 0.333333333 | 0.101626016 | 0.097222222 |
| SEQ ID NO: 26 (Assay 6)/SEQ ID NO: 1 (Assay 2) | 85 | 0.635294118 | 0.129546991 | 0.305882353 |
| SEQ ID NO: 26 (Assay 6)/SEQ ID NO: 26 (Assay 2 HM) | 78 | 0.551282051 | 0.105629877 | 0.269230769 |
| SEQ ID NO: 26 (Assay 6)/ MSP SEQ ID NO: 27.2) | 75 | 0.48 | 0.049767442 | 0.186666667 |
| SEQ ID NO: 1 (Assay 2)/SEQ ID NO: 26 (Assay 2 HM) | 79 | 0.620253165 | 0.114506038 | 0.303797468 |
| SEQ ID NO: 1 (Assay 2)/MSP SEQ ID NO: 27 (Assay 2) | 76 | 0.539473684 | 0.033726558 | 0.263157895 |
| SEQ ID NO: 26.2 HM)/MSP SEQ ID NO: 27 (Assay 2) | 87 | 0.471264368 | 0.025612194 | 0.252873563 |

TABLE 11

Proportion of whole blood samples detected within thresholds 0.01% to 0.1% methylation

| Panel | N samples | 0.01% methylation | 0.1% methylation |
|---|---|---|---|
| SEQ ID NO: 24 (Assay 5)/SEQ ID NO: 25 (Assay 3) | 26 | 0.076923077 | 0 |
| SEQ ID NO: 24 (Assay 5)/SEQ ID NO: 26 (Assay 6) | 26 | 0.192307692 | 0.038461538 |
| SEQ ID NO: 24 (Assay 5)/SEQ ID NO: 1 (Assay 2) | 27 | 0.111111111 | 0 |
| SEQ ID NO: 24 (Assay 5)/SEQ ID NO: 26 (Assay 2 HM) | 21 | 0.285714286 | 0.095238095 |
| SEQ ID NO: 24 (Assay 5)/MSP SEQ ID NO: 27 (Assay 2) | 21 | 0.095238095 | 0.047619048 |
| SEQ ID NO: 25 (Assay 3)/SEQ ID NO: 26 (Assay 6) | 26 | 0.153846154 | 0.038461538 |
| SEQ ID NO: 25 (Assay 3)/SEQ ID NO: 1 (Assay 2) | 27 | 0.074074074 | 0 |
| SEQ ID NO: 25 (Assay 3)/SEQ ID NO: 26 (Assay 2 HM) | 21 | 0.285714286 | 0.095238095 |
| SEQ ID NO: 25 (Assay 3)/MSP SEQ ID NO: 27 (Assay 2) | 21 | 0.095238095 | 0.047619048 |
| SEQ ID NO: 26 (Assay 6)/SEQ ID NO: 1 (Assay 2) | 27 | 0.185185185 | 0.037037037 |
| SEQ ID NO: 26 (Assay 6)/SEQ ID NO: 26 (Assay 2 HM) | 21 | 0.333333333 | 0.095238095 |
| SEQ ID NO: 26 (Assay 6)/MSP SEQ ID NO: 27 (Assay 2) | 21 | 0.142857143 | 0.047619048 |
| SEQ ID NO: 1 (Assay 2)/SEQ ID NO: 26 (Assay 2 HM) | 22 | 0.272727273 | 0.090909091 |
| SEQ ID NO: 1 (Assay 2)/MSP SEQ ID NO: 27 (Assay 2) | 22 | 0.136363636 | 0.045454545 |
| SEQ ID NO: 26 (Assay 2 HM)/MSP SEQ ID NO: 27 (Assay 2) | 24 | 0.291666667 | 0.083333333 |

TABLE 12

Differentiation between blood and colorectal carcinoma sample as illustrated in FIGS. 30-37.*

| Figure | Assay | AUC of ROC | Sensitivity/Specificity | Wilcoxon P-value |
|---|---|---|---|---|
| 30 | SEQ ID NO: 165 (Assay 1) | 0.76 (0.58, 0.89) | 0.62/0.86 | 0.371 |
| 31 | SEQ ID NO: 24 (Assay 5) | 0.98 (0.93, 1) | 0.96/0.93 | 0 |
| 32 | SEQ ID NO: 25 (Assay 3) | 0.89 (0.82, 0.94) | 0.78/1 | 0 |
| 33 | SEQ ID NO: 26 (Assay 6) | 0.99 (0.95, 1) | 0.99/0.85 | 0 |
| 34 | SEQ ID NO: 1 (Assay 2) | 0.99 (0.95/1) | 0.98/0.93 | 0 |
| 35 | SEQ ID NO: 376 (Assay 2 MSP) | 0.57 (0.48, 0.65) | 0.14/0.86 | 0.2399 |
| 36 | SEQ ID NO: 26 (Assay 2 HM) | 0.94 (0.87, 0.97) | 0.86/0.88 | 0 |
| 37 | SEQ ID NO: 27 (Assay 2 MSP) | 0.89 (0.82, 0.94) | 0.81/0.87 | 0 |

*confidence intervals are shown in brackets

TABLE 13

Sample set 1 according to Example 3.

| Sample Type | Sex | Age | Stage | T | N | M | Location |
|---|---|---|---|---|---|---|---|
| CRC | F | 39 | III | 4 | 1 | 0 | sigmoid |
| CRC | F | 65 | III | 3 | 2 | 0 | ileo-cecum |
| CRC | M | 58 | IV | | | | rectum |
| CRC | M | 63 | III | 3 | 1 | 0 | rectum |
| CRC | M | 71 | II | | | | ascending |
| CRC | F | 69 | I | 2 | 0 | 0 | cecum |
| CRC | F | 54 | III | 3 | 2 | 0 | cecum |
| CRC | M | 44 | IV | | | | |
| CRC | F | 75 | IV | | | | transverse |
| CRC | F | 60 | II | | | | rectum |
| CRC | M | 76 | I | | | | descending |
| CRC | M | 69 | IV | | | | sigmoid |
| CRC | M | 73 | I | 1 | 0 | 0 | rectum |
| CRC | M | | II | 3 | 0 | 0 | ascending |
| CRC | M | 62 | III | 3 | 1 | | |
| CRC | F | 49 | IV | | | | ascending |
| CRC | F | 58 | III | 3 | 1 | X | ascending |
| CRC | M | 42 | IV | 3 | 0 | 1 | |
| CRC | M | 64 | I | 2 | 0 | 0 | sigmoid |
| CRC | F | 64 | III | | | | rectum |
| CRC | F | 70 | III | 3 | 1 | 0 | terminal ileum |
| CRC | M | 67 | | | | | |
| CRC | M | 80 | III | 3 | 1 | 0 | rectosigmoid |
| CRC | F | 72 | IV | | | | sigmoid |
| CRC | M | | III | | | | rectum |
| CRC | M | 56 | I | 2 | 0 | 0 | sigmoid |
| CRC | M | 72 | III | 2 | 1 | 0 | rectum |
| CRC | M | 45 | IV | 4 | 2 | 1 | cecum |
| CRC | F | | II | 3 | 0 | 0 | |
| CRC | M | 74 | III | 3 | 1 | 0 | rectosigmoid |
| CRC | F | 75 | III | 4 | 2 | 0 | cecum wall |
| CRC | M | | III | 3 | 1 | 0 | |
| CRC | M | | I | 2 | 0 | 0 | ascending |
| CRC | F | 74 | I | 2 | 0 | 0 | cecum |
| CRC | M | 62 | I | 2 | 0 | 0 | rectosigmoid |
| CRC | F | 60 | II | 3 | 0 | 0 | rectum |
| CRC | F | 80 | II | | | | ascending |
| CRC | F | 70 | III | 4 | 2 | 0 | rectum |
| CRC | M | | III | 3 | 1 | 0 | |
| CRC | F | 75 | III | 3 | 1 | 0 | ascending |
| CRC | F | 49 | IV | 4 | X | 1 | rectum |
| CRC | F | 47 | I | | | | anus |
| CRC | M | 81 | IV | | | 1 | |
| CRC | F | 89 | III | 3 | 1 | 0 | rectum |
| CRC | M | 85 | III | 3 | 1 | 0 | cecum |
| CRC | M | 52 | III | 2 | 1 | 0 | |
| CRC | M | 75 | II | | | | sigmoid |
| CRC | M | | | | | | |
| CRC | F | 71 | | | | | |
| CRC | M | | III | | | | rectum |
| CRC | M | 61 | | 3 | x | 0 | descending |
| CRC | F | 56 | unk | | | | sigmoid |
| CRC | F | 68 | IV | 3 | 2 | 1 | sigmoid |
| CRC | F | 65 | III | 3 | 2 | 0 | ileo-cecum |
| CRC | M | 88 | II | 3 | 0 | 0 | flexure |
| CRC | F | 72 | III | | | | cecum |
| CRC | M | 61 | IV | 3 | 2 | 1 | rectum |
| CRC | M | | III | 3 | 2 | | |
| CRC | M | 52 | II | 3 | 0 | 0 | transverse |
| CRC | M | 66 | IV | 2 | 0 | 1 | rectum |
| CRC | M | 64 | III | | | | ascending |
| CRC | F | 65 | II | 3 | 0 | 0 | |
| CRC | M | 61 | IV | 3 | 2 | 1 | sigmoid |
| CRC | M | 64 | III | 3 | 1 | 0 | ascending |
| CRC | M | 76 | 0 | 0 | | | sigmoid |
| CRC | M | 64 | I | 2 | 0 | 0 | ascending |
| CRC | M | 56 | I | 2 | 0 | 0 | transverse |
| CRC | F | 67 | II | 3 | 0 | 0 | sigmoid |
| CRC | M | | II | 3 | 0 | 0 | ascending |
| CRC | M | 66 | III | 4 | 1 | 0 | |
| CRC | M | | II | 3 | 0 | 0 | |
| CRC | F | | III | | | | |
| CRC | F | 65 | I | 2 | 0 | X | rectum |
| CRC | M | | II | 3 | 0 | 0 | |
| CRC | M | 40 | I | | | | FAP |
| CRC | M | 77 | I | 2 | 0 | 0 | rectosigmoid |
| CRC | M | 65 | III | 4 | 2 | 0 | descending |
| CRC | M | 68 | IV | | | | sigmoid |
| CRC | M | 67 | II | | | | rectum |
| CRC | M | | unk | | | | rectum |
| CRC | F | 63 | | 3 | x | 0 | |
| CRC | M | 68 | unk | | | | descending |
| CRC | F | 53 | III | 3 | 1 | 0 | ascending |
| CRC | M | | II | 3 | 0 | 0 | |
| CRC | M | 68 | I | 2 | 0 | 0 | rectum |
| CRC | M | 84 | III | | | | rectum |
| CRC | F | 53 | I | 1 | 0 | 0 | descending |
| CRC | M | 72 | III | 4 | 1 | 0 | |
| CRC | F | 69 | I | 1 | 0 | 0 | sigmoid |
| CRC | M | | II | 3 | 0 | 0 | descending |
| CRC | M | | II | 3 | 0 | 0 | cecum |
| Normal Blood | F | 62 | n.a. | n.a. | n.a. | n.a. | n.a. |
| Normal Blood | M | 62 | n.a. | n.a. | n.a. | n.a. | n.a. |
| Normal Blood | F | 44 | n.a. | n.a. | n.a. | n.a. | n.a. |
| Normal Blood | F | 57 | n.a. | n.a. | n.a. | n.a. | n.a. |
| Normal Blood | F | 51 | n.a. | n.a. | n.a. | n.a. | n.a. |
| Normal Blood | M | 66 | n.a. | n.a. | n.a. | n.a. | n.a. |
| Normal Blood | M | 65 | n.a. | n.a. | n.a. | n.a. | n.a. |
| Normal Blood | M | 55 | n.a. | n.a. | n.a. | n.a. | n.a. |
| Normal Blood | F | 70 | n.a. | n.a. | n.a. | n.a. | n.a. |
| Normal Blood | M | 40 | n.a. | n.a. | n.a. | n.a. | n.a. |
| Normal Blood | F | 42 | n.a. | n.a. | n.a. | n.a. | n.a. |
| Normal Blood | F | 68 | n.a. | n.a. | n.a. | n.a. | n.a. |
| Normal Blood | F | 67 | n.a. | n.a. | n.a. | n.a. | n.a. |
| Normal Blood | F | 53 | n.a. | n.a. | n.a. | n.a. | n.a. |

TABLE 13-continued

Sample set 1 according to Example 3.

| Sample Type | Sex | Age | Stage | T | N | M | Location |
|---|---|---|---|---|---|---|---|
| Normal Blood | F |  | n.a. | n.a. | n.a. | n.a. | n.a. |
| Normal Blood | F | 50 | n.a. | n.a. | n.a. | n.a. | n.a. |
| Normal Blood | M | 50 | n.a. | n.a. | n.a. | n.a. | n.a. |
| Normal Blood | M | 51 | n.a. | n.a. | n.a. | n.a. | n.a. |
| Normal Blood | M | 56 | n.a. | n.a. | n.a. | n.a. | n.a. |
| Normal Blood | M | 58 | n.a. | n.a. | n.a. | n.a. | n.a. |
| Normal Blood | M | 67 | n.a. | n.a. | n.a. | n.a. | n.a. |
| Normal Blood | M | 55 | n.a. | n.a. | n.a. | n.a. | n.a. |
| Normal Blood | M | 62 | n.a. | n.a. | n.a. | n.a. | n.a. |
| Normal Blood | M | 66 | n.a. | n.a. | n.a. | n.a. | n.a. |
| Normal Blood | F | 56 | n.a. | n.a. | n.a. | n.a. | n.a. |
| Normal Blood | M | 56 | n.a. | n.a. | n.a. | n.a. | n.a. |
| Normal Blood | F | 69 | n.a. | n.a. | n.a. | n.a. | n.a. |

TABLE 14

Sample set 2 according to Example 3.

| Sample Type | Sex | Age | Stage | T | N | M | Location |
|---|---|---|---|---|---|---|---|
| CRC | F | 49 | IV |  |  |  | ascending |
| CRC | F | 72 | IV |  |  |  | sigmoid |
| CRC | M | 69 | IV |  |  |  | sigmoid |
| CRC | F | 58 | III | 3 | 1 | X | ascending |
| CRC | F | 60 | II |  |  |  | rectum |
| CRC | F | 74 | I | 2 | 0 | 0 | cecum |
| CRC | F | 70 | III | 3 | 1 | 0 | terminal ileum |
| CRC | F | 69 | I | 2 | 0 | 0 | cecum |
| CRC | F | 39 | III | 4 | 1 | 0 | sigmoid |
| CRC | M | 56 | I | 2 | 0 | 0 | sigmoid |
| CRC | F |  | II | 3 | 0 | 0 |  |
| CRC | M | 64 | I | 2 | 0 | 0 | sigmoid |
| CRC | M | 45 | IV | 4 | 2 | 1 | cecum |
| CRC | F | 54 | III | 3 | 2 | 0 | cecum |
| CRC | M | 42 | IV | 3 | 0 | 1 |  |
| CRC | M | 73 | I | 1 | 0 | 0 | rectum |
| CRC | M | 62 | III | 3 | 1 |  |  |
| CRC | M |  | I | 2 | 0 | 0 | ascending |
| CRC | F | 75 | III | 3 | 1 | 0 | ascending |
| CRC | M | 74 | III | 3 | 1 | 0 | rectosigmoid |
| CRC | F | 68 | IV | 3 | 2 | 1 | sigmoid |
| CRC | F | 75 | IV |  |  |  | transverse |
| CRC | M | 85 | III | 3 | 1 | 0 | cecum |
| CRC | M | 80 | III | 3 | 1 | 0 | rectosigmoid |
| CRC | M | 66 | III | 4 | 1 | 0 |  |
| CRC | F | 70 | III | 4 | 2 | 0 | rectum |
| CRC | F | 89 | III | 3 | 1 | 0 | rectum |
| CRC | M | 67 |  |  |  |  |  |
| CRC | F | 67 | II | 3 | 0 | 0 | sigmoid |
| CRC | M | 66 | IV | 2 | 0 | 1 | rectum |
| CRC | F | 56 | unk |  |  |  | sigmoid |
| CRC | M | 72 | III | 2 | 1 | 0 | rectum |
| CRC | M | 80 | II |  |  |  | ascending sigmoid |
| CRC | M | 75 | II |  |  |  |  |
| CRC | F | 49 | IV | 4 | X | 1 | rectum |
| CRC | M |  | III |  |  |  | rectum |
| CRC | F | 60 | II | 3 | 0 | 0 | rectum |
| CRC | M | 62 | I | 2 | 0 | 0 | rectosigmoid |
| CRC | M | 88 | II | 3 | 0 | 0 | flexure |
| CRC | M | 61 | IV | 3 | 2 | 1 | sigmoid |
| CRC | M | 61 |  | 3 | x | 0 | descending |
| CRC | F | 64 | III |  |  |  | rectum |
| CRC | M |  | III |  |  |  | rectum |
| CRC | M | 52 | II | 3 | 0 | 0 | transverse |
| CRC | F | 71 |  |  |  |  |  |
| CRC | M | 81 | IV |  |  | 1 |  |
| CRC | F | 65 | III | 3 | 2 | 0 | ileo-cecum |
| CRC | M |  |  |  |  |  |  |
| CRC | F | 65 | II | 3 | 0 | 0 |  |
| CRC | F | 72 | III |  |  |  | cecum |
| CRC | M | 61 | IV | 3 | 2 | 1 | rectum |
| CRC | M | 52 | III | 2 | 1 | 0 |  |
| CRC | M |  | II | 3 | 0 | 0 |  |
| CRC | F | 47 | I |  |  |  | anus |
| CRC | M |  | II | 3 | 0 | 0 | ascending |
| CRC | M | 64 | III | 3 | 1 | 0 | ascending |
| CRC | M | 64 | I | 2 | 0 | 0 | ascending |
| CRC | M | 76 |  | 0 | 0 |  | sigmoid |
| CRC | M | 56 | I | 2 | 0 | 0 | transverse |
| CRC | M | 65 | III | 4 | 2 | 0 | descending |
| CRC | M | 40 | I |  |  |  | FAP |
| CRC | F | 53 | I | 1 | 0 | 0 | descending |
| CRC | M |  | II | 3 | 0 | 0 |  |
| CRC | M |  | III | 3 | 2 |  |  |
| CRC | M |  | unk |  |  |  | rectum |
| CRC | M | 68 | I | 2 | 0 | 0 | rectum |
| CRC | F | 63 |  | 3 | x | 0 |  |
| CRC | F |  | III |  |  |  | rectum |
| CRC | M | 67 | II |  |  |  | rectum |
| CRC | F | 65 | I | 2 | 0 | X | rectum |
| CRC | M | 64 | III |  |  |  | ascending |
| CRC | M | 68 | IV |  |  |  | sigmoid |
| CRC | M |  | II | 3 | 0 | 0 |  |
| CRC | M | 72 | III | 4 | 1 | 0 |  |
| CRC | M | 77 | I | 2 | 0 | 0 | rectosigmoid |
| CRC | F | 53 | III | 3 | 1 | 0 | ascending |
| CRC | F | 69 | I | 1 | 0 | 0 | sigmoid |
| CRC | M | 84 | III |  |  |  | rectum |
| CRC | M |  | II | 3 | 0 | 0 | descending |
| CRC | M | 68 | unk |  |  |  | descending |
| CRC | M |  | II | 3 | 0 | 0 | cecum |
| Normal Blood | M | 55 | n.a. | n.a. | n.a. | n.a. | n.a. |
| Normal Blood | M | 62 | n.a. | n.a. | n.a. | n.a. | n.a. |
| Normal Blood | F | 57 | n.a. | n.a. | n.a. | n.a. | n.a. |
| Normal Blood | F | 62 | n.a. | n.a. | n.a. | n.a. | n.a. |
| Normal Blood | M | 65 | n.a. | n.a. | n.a. | n.a. | n.a. |
| Normal Blood | F |  | n.a. | n.a. | n.a. | n.a. | n.a. |
| Normal Blood | F | 44 | n.a. | n.a. | n.a. | n.a. | n.a. |
| Normal Blood | F | 68 | n.a. | n.a. | n.a. | n.a. | n.a. |
| Normal Blood | F | 70 | n.a. | n.a. | n.a. | n.a. | n.a. |
| Normal Blood | M | 58 | n.a. | n.a. | n.a. | n.a. | n.a. |
| Normal Blood | M | 62 | n.a. | n.a. | n.a. | n.a. | n.a. |
| Normal Blood | F | 53 | n.a. | n.a. | n.a. | n.a. | n.a. |
| Normal Blood | F | 42 | n.a. | n.a. | n.a. | n.a. | n.a. |
| Normal Blood | F | 51 | n.a. | n.a. | n.a. | n.a. | n.a. |
| Normal Blood | M | 66 | n.a. | n.a. | n.a. | n.a. | n.a. |

TABLE 14-continued

Sample set 2 according to Example 3.

| Sample Type | Sex | Age | Stage | T | N | M | Location |
|---|---|---|---|---|---|---|---|
| Normal Blood | M | 51 | n.a. | n.a. | n.a. | n.a. | n.a. |
| Normal Blood | M | 40 | n.a. | n.a. | n.a. | n.a. | n.a. |
| Normal Blood | M | 56 | n.a. | n.a. | n.a. | n.a. | n.a. |
| Normal Blood | F | 56 | n.a. | n.a. | n.a. | n.a. | n.a. |
| Normal Blood | F | 50 | n.a. | n.a. | n.a. | n.a. | n.a. |
| Normal Blood | M | 50 | n.a. | n.a. | n.a. | n.a. | n.a. |
| Normal Blood | F | 67 | n.a. | n.a. | n.a. | n.a. | n.a. |
| Normal Blood | M | 67 | n.a. | n.a. | n.a. | n.a. | n.a. |
| Normal Blood | M | 55 | n.a. | n.a. | n.a. | n.a. | n.a. |
| Normal Blood | M | 66 | n.a. | n.a. | n.a. | n.a. | n.a. |
| Normal Blood | M | 56 | n.a. | n.a. | n.a. | n.a. | n.a. |

TABLE 15

Proportion samples from sample set 1 according to Example 3 with methylation within various thresholds.

| Assays | CRC >10%** | CRC >20%** | CRC >30%** | Blood 2 of 2+* | Blood 1 of 2+** | Blood >1% |
|---|---|---|---|---|---|---|
| SEQ ID NO: 1 (Assay 2) | 75 | 62 | 46 | 1 | 1 | 0 |
| % | 82.41758 | 68.13187 | 50.54945 | 3.703704 | 3.703704 | 0 |
| SEQ ID NO: 6 (Assay 6)/SEQ ID NO: 1.2 | 79 | 69 | 59 | 2 | 11 | 5 |
| % | 86.81319 | 75.82418 | 64.83516 | 7.407407 | 40.74074 | 18.51852 |
| SEQ ID NO: 1 (Assay 2)/SEQ ID NO: 4 (Assay 5)/SEQ ID NO: 15174 (Assay 3) | 78 | 62 | 45 | 1 | 1 | 0 |
| % | 85.71429 | 68.13187 | 49.45055 | 3.703704 | 3.703704 | 0 |
| SEQ ID NO: 1 (Assay 2)/SEQ ID NO: 5 (Assay 3) | 77 | 66 | 51 | 1 | 1 | 0 |
| % | 84.61538 | 72.52747 | 56.04396 | 3.703704 | 3.703704 | 0 |
| SEQ ID NO: 6 (Assay 6)/SEQ ID NO: 1 (Assay 2)/SEQ ID NO: 4 (Assay 5) | 79 | 69 | 58 | 2 | 11 | 5 |
| % | 86.81319 | 75.82418 | 63.73626 | 7.407407 | 40.74074 | 18.51852 |
| SEQ ID NO: 1 (Assay 2)/SEQ ID NO: 4 (Assay 5)/SEQ ID NO: 15174 (Assay 3) | 78 | 66 | 51 | 1 | 1 | 0 |
| % | 85.71429 | 72.52747 | 56.04396 | 3.703704 | 3.703704 | 0 |
| SEQ ID NO: 1 (Assay 2)/SEQ ID NO: 6 (Assay 6)/SEQ ID NO: 15174 (Assay 3) | 79 | 69 | 59 | 2 | 11 | 0 |
| % | 86.81319 | 75.82418 | 64.83516 | 7.407407 | 40.74074 | 0 |

*Both replicates tested positive
**One of two replicates tested positive or measured within threshold

TABLE 16

Proportion samples from sample set 2 according to Example 3 with methylation within various thresholds.

| | CRC >10%* | CRC >20%* | CRC >30%* | Blood Positive* | Blood >1%* | NAT <5%* | NAT 5-10%* | NAT >10%* |
|---|---|---|---|---|---|---|---|---|
| SEQ ID NO: 1 (Assay 7) LC | 66 | 54 | 37 | 2 | 1 | 15 | 6 | 1 |
| % | 81.48148 | 66.66667 | 45.67901 | 7.692308 | 3.846154 | 68.18182 | 27.27273 | 4.545455 |
| SEQ ID NO: 1 (Assay 7)-LC/SEQ ID NO: 28 (Assay 2) | 69 | 57 | 42 | 3 | 2 | | | |
| % | 85.18519 | 70.37037 | 51.85185 | 11.53846 | 7.692308 | | | |
| SEQ ID NO: 1 (Assay 7)-LC/SEQ ID NO: 24 (Assay 5b) | 68 | 55 | 39 | 2 | 1 | | | |
| % | 83.95062 | 67.90123 | 48.14815 | 7.692308 | 3.846154 | | | |
| SEQ ID NO: 1 (Assay 7)-Taqman | 68 | 58 | 46 | 6 | 5 | | | |
| % | 83.95062 | 71.60494 | 56.79012 | 23.07692 | 19.23077 | | | |

*One of two replicates tested positive or measured within threshold

TABLE 17

Assays according to Example 3

| Genomic SEQ ID NO: | Assay | Primer | Primer | Blocker | Probe | Probe |
|---|---|---|---|---|---|---|
| SEQ ID NO: 24 (Assay 5) | HM | ccaaaaccta aacttacaac (SEQ ID NO: 102) | tctaaataac aaaatacctc catt (SEQ ID NO: 110) | Tacaacacc accaacaaa cccaaaaac acaa (SEQ ID NO: 104) | GTtAATTG CGGGCG AtCGA (SEQ ID NO: 105) | CGtCGttA GCGGGT GGG (SEQ ID NO: 106) |
| SEQ ID NO: 28 (Assay 2) | HM | GttTttTttAtt AGTTGGA AGAttT (SEQ ID NO: 111) | aAaCTaCA aCAaaCC TTaTC (SEQ ID NO: 112) | CCTTaTC CACACTa AAaCAaa CAaaCAa CACACAaaC (SEQ ID NO: 113) | CGtttACG GttCGCGCG (SEQ ID NO: 114) | CGttCGttT GtTTtAGC GCG (SEQ ID NO: 115) |
| SEQ ID NO: 29 (Assay 2b) | HM | ggtgttgtttatt ttagagagtt (SEQ ID NO: 116) | CTCCCCT AaCCCCT aTC (SEQ ID NO: 117) | CTaTCCT TCACCAC CTTCCCA aCACTaCA (SEQ ID NO: 118) | ttagggggg CGCGgga (SEQ ID NO: 119) | gttagatgC GtCGtagC Gttg (SEQ ID NO: 120) |

TABLE 18

Proportion samples from sample set 3 according to Example 3 with methylation within various thresholds.

| | CRC >10% | CRC >20% | CRC >30% | blood >0.1 | blood >1 | blood >10 | BC >10% | BC >20% | BC >30% |
|---|---|---|---|---|---|---|---|---|---|
| SEQ ID NO: 1 (Assay 2) | 6 | 5 | 5 | 0 | 0 | 0 | 4 | 2 | 2 |
| % | 50 | 41.66667 | 41.66667 | 0 | 0 | 0 | 28.57143 | 14.28571 | 14.28571 |

TABLE 19

Sample set 3 according to Example 3.

| Sample Type | Year of birth | Sex | Race | Diagnosis |
|---|---|---|---|---|
| CRC | 1938 | F | Asian | M0, N0, T3, adenocarcinoma, stage II, well differentiated |
| CRC | 1941 | F | Asian | M0, N1, T3, adenocarcinoma, moderately differentiated, stage III, sigmoid |
| CRC | 1956 | F | Asian | M0, N1, T2, adenocarcinoma, stage III, well differentiated |
| CRC | 1945 | F | Asian | M0, T2, adenocarcinoma, grade 2, N0 |
| CRC | 1961 | F | Asian | M0, N1, T3, adenocarcinoma, stage III, well differentiated, sigmoid |
| CRC | 1945 | F | unknown | M0, N0, T2, adenocarcinoma, stage I, well differentiated, descending |
| CRC | 1970 | F | Asian | M0, N0, T3, adenocarcinoma, moderately differentiated, stage II, ascending |
| CRC | 1941 | F | Asian | M0, N0, T3, adenocarcinoma, moderately differentiated, stage II, sigmoid |
| CRC | 1952 | F | White | M1, T3, ulcerative, low grade, cancer, sigmoid, stromal |
| CRC | 1948 | F | Asian | M0, N1, T3, adenocarcinoma, stage III, ascending, grade 1 |
| CRC | 1947 | F | Asian | M0, N0, T3, adenocarcinoma, stage II, well differentiated, grade 1 |
| CRC | 1955 | F | Asian | M0, N0, T3, adenocarcinoma, stage II, well differentiated, grade 1, rectum |

| Sample Type | Age | Sex |
|---|---|---|
| Blood | 16 | F |
| Blood | 33 | F |
| Blood | 33 | F |
| Blood | 35 | F |
| Blood | 23 | F |
| Blood | 35 | F |
| Blood | 19 | F |
| Blood | 36 | F |
| Blood | 24 | F |
| Blood | 37 | F |

TABLE 19-continued

Sample set 3 according to Example 3.

| Sample Type | Age | Sex | Menopausal-StageAtTime-OfDiagnosis | BC StageNStageValue |
|---|---|---|---|---|
| Breast Cancer | 63 | F | postmenopausal | N1 |
| Breast Cancer | 59 | F | postmenopausal | N0 |
| Breast Cancer | 56 | F | postmenopausal | N0 |
| Breast Cancer | 45 | F | premenopausal | N2 |
| Breast Cancer | 85 | F | postmenopausal | N0 |
| Breast Cancer | 65 | F | postmenopausal | N0 |
| Breast Cancer | 32 | F | premenopausal | N2 |
| Breast Cancer | 47 | F | premenopausal | N1 |
| Breast Cancer | 44 | F | premenopausal | N0 |

TABLE 19-continued

Sample set 3 according to Example 3.

| Breast Cancer | 29 | F | premenopausal | N1 |
|---|---|---|---|---|
| Breast Cancer | 37 | F | premenopausal | N0 |
| Breast Cancer | 44 | F | premenopausal | N0 |
| Breast Cancer | 52 | F | postmenopausal | N0 |
| Breast Cancer | 54 | F | premenopausal | N0 |

TABLE 20

Results of Example 4

| Disease type | total +samples | total sample # |
|---|---|---|
| *Other cancers* | | |
| Bladder | 4 | 10 |
| Breast | 5 | 29 |
| Liver | 7 | 9 |
| Lung | 10 | 26 |
| Prostate | 5 | 29 |
| Stomach | 2 | 7 |
| Pancreas | 1 | 8 |
| *Other diseases* | | |
| appendicitis | 1 | 6 |
| cholecystitis | 3 | 10 |
| IBD | 4 | 17 |
| diabetes | 3 | 10 |
| esophagitis | 2 | 10 |
| gastritis | 3 | 11 |
| chronic heart disease | 5 | 10 |
| pancreatitis | 3 | 10 |
| pyelonephritis | 5 | 10 |
| respiratory tract infection | 3 | 10 |
| severe allergy | 4 | 11 |
| diverticulosis/diverticulitis | 0 | 5 |
| rheumatoid arthritis | 0 | 9 |
| chronic renal disease | 0 | 9 |
| non-rheumatoid arthritis | 0 | 10 |

TABLE 21

Primers and genomic equivalents of amplificates according to Example 5.

| Amplicon name | Amplicon size | Amplicon name in figures | Genomic Amplicon equivalent SEQ ID NO: | PCR primer 1 | Primer 1 SEQ ID NO: | PCR primer 2 | Primer 2 SEQ ID NO: |
|---|---|---|---|---|---|---|---|
| gamma-rc1 | 493 | 1 | 129 | gamma-rc1F | 130 | gamma-rc1R | 131 |
| gamma-rc2 | 428 | 2 | 132 | gamma-rc2F | 133 | gamma-rc2R | 134 |
| gamma-3-2 | 557 | 3 | 135 | gamma-3F_2 | 136 | gamma-3R | 137 |
| gamma-4 | 556 | 4 | 138 | gamma-4F | 139 | gamma-4R | 140 |
| epsilon-1 | 529 | 5 | 141 | epsilon-1F | 142 | epsilon-1R | 143 |
| epsilon-rc2 | 550 | 6 | 144 | epsilon-rc2F | 145 | epsilon-rc2R | 146 |
| epsilon-rc3 | 423 | 7 | 147 | epsilon-rc3F | 148 | epsilon-rc3R | 149 |
| beta-rc1 | 282 | 8 | 150 | beta-rc1F | 151 | beta-rc1R | 152 |
| alpha-1 | 459 | 9 | 153 | alpha-1F | 154 | alpha-1R | 155 |
| alpha | 260 | 10 | 156 | alpha-F | 157 | alpha-R | 158 |

Note:
Amplicons with "rc" in their names were amplified from the Bis2 strand, others from the Bis1 strand.

TABLE 22

Oligomers according to Example 6

| genomic target sequence SEQ ID NO: | Oligomer SEQ ID NO: | Sequence | Type of Oligomer | Melting Temp |
|---|---|---|---|---|
| 159 | 204 | ggtgggtggttagtgaa | Forward Primer | 44.3 |
|  | 205 | ttattataacaataatacctaaaaaaaa | Reverse Primer | 46.06 |
|  | 206 | ggtgagtaagcgtttacgtcg | Probe | 54.26 |
|  | 207 | cgagcgtcggggagg | Probe | 52.37 |
|  | 208 | aaaacacatcaaaaccacaaaatttacaaaaacacaaca | Blocker | 59.78 |
|  | 209 | tttagtatgttttttaattagagtgttaa | Forward Primer | 49.12 |
|  | 210 | cctaacaaacttaactactccc | Reverse Primer | 48.61 |
|  | 211 | cgggatttaggcggtcg | Probe | 51.86 |
|  | 212 | attttcggaggttttcgattagg | Probe | 52.71 |
|  | 213 | ctcccaaaccctcattccaacccca | Blocker | 58.58 |
|  | 214 | ccccaaaccctccc | Forward Primer | 41.62 |
|  | 215 | tttgtttaggaatttgtagttgt | Reverse Primer | 47.21 |
|  | 216 | cgggttaggaagttcgcg | Probe | 52.98 |
|  | 217 | gacgtcgcgattgtttttg | Probe | 51.64 |
|  | 218 | ccccaccacaaacacctaacctcccc | Blocker | 59.6 |
| 160 | 219 | ccctctacctccctact | Forward Primer | 46.15 |
|  | 220 | ggagagaatagggggt | Reverse Primer | 42.66 |
|  | 221 | ggtggggcgtcgtcg | Probe | 51.26 |
|  | 222 | cgttacggttttggtgtcg | Probe | 51.77 |
|  | 223 | caaactaaacctatcaaaaatcttttacaatcaacaaccc | Blocker | 60.64 |
| 161 | 224 | ctaaaccaaataaaaaaaaaataaaaac | Forward Primer | 46.6 |
|  | 225 | gatgggtaggtatagatttttag | Reverse Primer | 46.36 |
|  | 226 | ggattttttttcgaagcgttttttt | Probe | 51.89 |
|  | 227 | taagagcgcgttttttatcgaa | Probe | 53.76 |
|  | 228 | aaataaaaacacactaaacacaccaccatacact | Blocker | 58.53 |
| 162 | 229 | ttttgagtgagtttttaaatttt | Forward Primer | 45.08 |
|  | 230 | cctcctccctccactaac | Reverse Primer | 48.57 |
|  | 231 | tcgttttttggaatgggcg | Probe | 51.75 |
|  | 232 | acgcgaggtacggattttagg | Probe | 55.05 |
|  | 233 | taaccacctttctccatccaacatccca | Blocker | 58.99 |

TABLE 22-continued

Oligomers according to Example 6

| genomic target sequence SEQ ID NO: | Oligomer SEQ ID NO: | Sequence | Type of Oligomer | Melting Temp |
|---|---|---|---|---|
| | 234 | agtggagggaaggatgt | Forward Primer | 45.98 |
| | 235 | aactctacaaacccaaaataaa | Reverse Primer | 46.17 |
| | 236 | gagttcgttttgtagggcgg | Probe | 53.18 |
| | 237 | cgggcggttttggg | Probe | 46.11 |
| | 238 | taaacaaccccactcaaaccaaacaccc | Blocker | 57.79 |
| | 239 | ctatatattataaaaattataatccacc | Forward Primer | 46.43 |
| | 240 | gggttaaggtgttggtagt | Reverse Primer | 46.11 |
| | 241 | cgttagttttcggtaggtaggacg | Probe | 56.41 |
| | 242 | cgcggttgtttggcg | Probe | 49.99 |
| | 243 | ccacccaataacaacaaaacataccaccaattactaa | Blocker | 60.46 |
| 163 | 244 | tacccttaataaaaaaactcc | Forward Primer | 43.53 |
| | 245 | ttaggttgaggttggaaag | Reverse Primer | 46.08 |
| | 246 | cgaaggggttagttgtcgttga | Probe | 54.56 |
| | 247 | cgttagtacgtagatgtaattggttttcg | Probe | 57.45 |
| | 248 | ctcccacacctacaaaccaacactccacaa | Blocker | 61.25 |

SEQUENCE LISTING (390 sequences)

SEQ ID NO: 1 - DNA, 219909 bp, Homo Sapiens
cgttacccgagttgtaaagggcggctccctgtgtctgccccgctgcaccgatacaccgagctgcgcacggtgcccagcgcagggagaacaaatgatcatctgtccaacgcgcccatttacaggtgaggaaactaaggctccaactcaatcgacgcactctgcccttttgattaccagaaaagtagcaggacaggtgtcctgtcccgccctaccccggcccactaagccggcaccccggctccgacccccggctgtgcccggcgccgccgcggtgcccggcgccgccgcctcgcccggcggggccgcccggagcgcccgcacctccgcccgcttccacctggccgggcccgccccgcccggactcgggactgggaagtgcggcgactcccggaaccagccattggcgccagcgcggggagctgggggtgcagagctgcgggcgcggcgggccacgcaggcggcccccacccccggcctggcctggtctggtctggtctgcgctgccgcgcgggggcgccccctcccaggcccggcgcccgccagccccgctccgccaggtgcagcgcagcgcaggggtgggcgggggtggggctcggcgcgcacgttcacggggcggggagggggcgggtcaggggcgggaccacagccggctgggccggggttctatgcgcatctccggggaggggcggggcgggggcggggccggggcggggcccggtcggtgcactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgcggctgacatcctcactccaccctagcagggcccgccttaagtaggcgaagggggcctgacttgggcctcaccatgagccggttcaggagctttcatttcataagaggctcccgctctggcactctgaagttccatttcacagatgggcacaccgaggccacaagggcaggttaagagaaatccagatcttcattatttgtcttttccttccttttttttttcctttgtggttttctccaaaggatccaggcaggcaggatcctttgtcctcctcagtcctcaaattataaatagcgtctcctcttctaaatctagaaaccgtttgtttaatgtccctcctttaattcattcagatagaaaggtacctgccaaggatccatgaattaatttttattgataggagaacagaatcatgggccttagttggaggtgaaggagtcatcggggccatccccctgcctttgggccattgtcggtttcctctggctttccatatttaggaaccaaaatgagtgataaagtaccttgtctcaaagaggattactcagaacttccccgaaaatacccttctgggtcagtagcttagaatttcaactttcacccggttgttgcgaacaagatggccctctacgcacccggagcacagctctgtcaggagcgtgggtgggttggtgtgctggtgggcgggagcgggcttccaggtggcacatgcttggttttggcaccggggcttcctccccaacatgctccaaatacttgagattgttgtggggatcgcgcggtgcatggccctttccaggggatctctagcccgcccagggagggccctttgcccttggtttcttacactttacctcccactggtgggtccagacagtgggggtgaccggggtcctcccaggtcgtgggtcctgggttttttctgcggagaccctcctgcacagatgccggaagggccctgaggcaggcttggagtctctgcacctgcggcttactgggaggtggggagaccatcacttgtccttttctcctctcctccacacacacctaccccacccctcactgggtttcttttttttttttttttttaaaaaaaaggacagaaccttttgcagtaggtggaagtagagtttgtggagtgagcaggaaccaactcttgtacagcagcctcggtgcctccttgtgtttacctaaaggggcaggcccctctgaggatgggggaagggagggctcagaccatttctggtttgctccctgcttggcagtggcccaaggtgtgctgggtcactgtgttgcagttgtatggagtgggactggagggggctgatggtgggggtggcctcttgccctcattctgagtgtcctggagctgtcttggcaccagcccttttccgggtacgggcactcgcaggagtcaggctgaccccccaacaagccatcgacaccatgaaattaaggaaagcagcaaaagatgttaaaaatcccccaaggctctgacaatccaaggacaacaggaaggtctttattttttcatctagactgtgcgggattattgcttccagacctgtatgtgggcttcagaataaacggaatgaccataatgttgttcccggtagacctggtttgaacattcgtgagcctctgaaaaggagaaagattttagaaggatgtgttggggcaatctcaagtaccgtgggtctatagacagtcatcgaagacactttatgtgctgggcacacatggccaagtctgagtgggtacagaaatggtaatgagatatagtccttgcctgcagagaacttacattctcaccgggagtcaggatgagggcgagacaccagctcattaacacccttccctcctgagcagttcagcctccaaatactacaggaatgccccggaggttttaggtggaggtgagattgagctgggccttgaggaaggagaagtcttgagtagtggagaataaaaagggacttggccaggtgcgcttgaagtcccagctactcaggaggctgagacacgaggatcgcttgagcccaggaggctactcaggaggctgagacacgaggatcgcttgagcccaggaggctactcaggaggctgagacaggaggatcgcttgaagccaggagttcaaggctgcagccctgtgacagcgcctggaaatagacacggcactccagcctgggtggcgtcatgagaccccatctgtaagaaggtcttttccaatgcggaaggcagcaagggcccacacagggcagctgcaggatccagggggacactggggacaggttctctctggcagctccactgctgctccaggctttcccgattgcctcacccggccttccaatggggtggaggtagtggtagtctacaggcagtgtggtccagtggttacacttgggggctcagagccgccagccccttgggattaaatctcaccaggctgcgcctctccctgtggcacaaggttctcacctcatgcatctcatttgcctcatttgtttttttgtgtgtgtggtgttttttaattttatttatttatttatttttgagacggagtctcactctgtctcccaggctggagtgcaatggcatgatctcagcttactgcaacctccgcctcccaggttcaagtgattctcctgcctcagcctcctgagtggctgggattgtaggaacgtgccactgcgcccagctaatttttatatttttactagagatggggtttcaccatgttggtcaggctgatctcgaactcctgacctcgtgatctgcctgccttggcctcccaaagtgctgtgattacaggcatgagccaccacgcccagcctgcctcatttgttaaatgggacagtgctatgttgttgtaaaggttaaacgagttcatatttgaaaaagctgagaaatgcctgctctgtaacctgttagctgctgtcatgatcatgattgtcattgacaggaggatggagaaggctggggttacgccattgctaggacgttccagaagcctccatgatcttcccttactgtggtcagagcatggtgcagggtctctcccccagcccctcagcactggagccagctgcactgtacccgccctggctctctaggttctgagttttgggactccctttgcatactaggtcacatggaacttgccgtcattcccaggctcccctggaaactctctgtgggtggcagcggcaggaggacttacccgaggccgatgagccacagaagcgggactgaggttgcgtcacacccctactggcacctgggaattactctggagattctttttttattttttatttttttgagatggagtcttgctctgttgcccaggctggagtgcagtggcacgatctcggttcactgcaacctctgcctcccaggttcaagcaattctcatgcctcagcctcctgagtagctgggattacaggcatgtgccaccgtgcccagctaatttttgtattttttagtagagatggggttttaccatactggccaggctggtctcgaactccggacctcaggtgatccacccgcctcagcctcccaaagtgctgggatcacaggcatgagccaccgtgcccagccactctggagtttctctgtggctttcaggagattcctgaaggggcaccagccacgattaaaaagctctatgctgtcgtgacttctgagtcctgggcagggagggaggctgcacccacacaggaagcagcttctgccgtgattcagtgtgctggctcgccgtggtggacagggctgcaccctcacccagcgccccgggagctgacttacgggaagggcaaggaattgcaccctcagagaacacttccccagtcagctaacccggtgacaggcgagcgtgggaagggcacaagcacagggtttcttcctcttctcccccagccccgtctccgcgcctgttctcgctgcctcttgcctcctcacgtccaagcttgtctgctctggcgcattcaggggacctggactggagagaaaaagccacctcgtacggttagtctgtggctctgtctgacttgtgtcctccgccgaggcccctcagttgtgagacagctggctgagcctaagtcctggggccagccctctccctagtctgttgcaaaggtagaaaggcatgcccaggcaggggccacctgccctgcccgctcacgccagaccgcaggcacttgcccgtcagatctccccggcctgcccagagggattctgatagccgagggcaatgcacctggcagcggagcattgcgtttgcgacagtccaccttcttcctggaaccaccccccacaagtgtgaccagctcaagccaggacaggtacagggggacccaggattgccacttaggggcagtggtctggaatccaggtccaggtgacatgggagccaaccctctgcttggagatcccaggtgggtgtttgcagaggacatctcacttgaggacccatggaaggggacacttcccaccccctacctggtccttgggctgccctcctctgacactctcctgccatcccaggcagccctgacagccccatgtgactgggacctagaggtggcccctgtttccgccccagtgtttgtccacaggcagtgttgcgtgggctctgaagtttgcctaagatggacctgataaggggagttcagtacacatcagtgcaggcccggccagggggtgatgatggcagttcctgggcagatccagctggctttagggtaggaggggctccagagagaggctccaggcccctaggggtgtgaacctttggggtgaggcgggaagtgacgcgctgggttcctgcgcctctgtttgttggagctattaccttggaaacatcccagctctaggcggttgccagggatttatggggatcagtgggtgccaatccctgggtgaagccctcggggcttgtacacagcacacagcgctgtggccccatggctcactttgctgtgtgaagtggctcagtctccgggagagtccttagccaggcaggcctgacggcaactgccaggtcatggtgatctggaatcgctgaccaaagggagtcagtcctggtgggtggagggacttggtgggcagccatcgtgatgccaggcatggggatcgtgtgtcacccaggcctgtgggtgccgagcttctgtgggagcagtgaagtgcccccgtggccgatgggctggtcacccctgcccctttcctgatgtgacagttgtgcctgggccccgggaaatttgccaggaggcctggcattggcctgctctactggagcggccctgctgagctgtgagctgcccgtctccctgaggttcctagcccatttcaactctccatgtggatttggtcattcattccagaagcgtctgccgggcgctgctgagtgtcaggttctgtttgcctcctctcctgtacgctggaggctctgggcaccagctctgcagggtggcctggccttgggtctccagggtagagcatggcactctctgctcccagcccagtttctctctgctttatctccctgaccccaccctgggcatgggcccatttgcagcccctgtgaagggagacattgagctgttgctggcagaggaggggcggctcctgggcactgcttgccaatggcctctcggcagctctgtgacagctgagctttgttcccagcctaatctgacctggttctccaaagcatgactgttggcagcctgaaaacctccaggacaggaaacaggagtggcgcagggaatgtaagatgatcccagcttcaagtcactgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggtgggtgcattgctctctttccggctcctcccaggctgcttaaatgacctgtgacgaggcctgcgccatggccggggccctctgcttttcccagcgctgcacctgggaaccaggggttgggccccggaagccgaggatgtccctgaatgccatgcctgggcacctgtcctggccaggcgaggcgtgttggggcagcggctgagatgggagcagcagcattgcctgccaggtttgagatgggccccgggtgagtgtggttaccaggaagggctgggcagagcaggcgggtgggccgcccctggggccttgttccgcagatcaacctgatccgcaccctggggccggggcttcctttcacagccttcccatgaactatggctcctgtttccatcccaaatcagatcccagaagaggaataatgtccatgtaacccaagccagttggaagtgggttacatccaacccctgtcatcttccagcttgttaaggacttgactaactcaacccagagggatttggagggttgtctgcaaaacccactaataacagggaactttagctctgtagccacagggtctacagaggtgtcgggctgtcgggttattgctgggaggtgagccggtggcgtagacaccatggaggcaccggtagtggaagagctgcaagtgcacacagaggccggcaccgaggggcggggaggaggaggtggtggatttctcgccagtgttggcatcatgttgcctccagcatcagagacccaaggtgtggctgaccttggctggggcgatgagtcattggatagcagagccttcctggtagctgggggttaacgctttaactgccgggactttgtattatgccgcttcttttttttgttttgtttggtttggtttggtttggtttttgagacggagtctcactctgtcacccaggctggagtgtggtggctcaatcttggctcactgcaacctctgcctcctgggttcaagcaattctcctgcctcagcctcctgaatagctgggattacaggcacgcgccaccatgcctggctaatttttgtatttttagtagagatggggtttcgccatgttggccgggttggtttcaaactcctgacctcaggtgatccacctgccccggcctcccaaagtgctgggattacaggcatgagctaccgcgcccagcttgcatttatgcttttttttttttttttttgagatggagtttcgctcttgttgcccaggctggagtgcaaaggcgcgatctcagctcactgcaacctccacctcccgggttcaagcgattctcttgcctcagcctcccaagtagctgggattacaggcctgcgtcaccatgcccggctaattttgtatttttagtacagacggggtgtccccatgttggtcaggctggtctcgaactcccgacctcaggtgatccgcccgccttggcctcccaaagtgctgggattacaggcgtgagccaccgcacccggcctatgctttttattattattatttaattttttaaggaaagcaatctaaactgtacactgtatcttttctttctcttttgctttttgttgtcagttttctgtattacttattgccaaacaacatgaacaggaaattgaaaggaaaacttcaacaatcattggctgtagcatttcttctgtgttccattcagtgcttgtctcctcaggaacatgacatagggtttgatttaattatgaaaggcgtatattttcagagttttatactccccatagaatgaatgttgaattctgttcttttcacttgaaattagatctcaggcatggatttcatgattatcactataatggctcttcagagtggacattgcatcttgtagggaaccaccctctccccagctgctggtgtggacgctcctccttgatggtgtgggtctgggcccctgaagggtggtgtcctgagtaaagatgttacagtagccatgcttatagctttgggcctggggctaggtggagactggcttcaaccctagagcttgctgtcttaaaataaattcttttttttttttttttgagatggagtctcgctctgttgcccaggctggagtgcagtggcgcgatctccgctcactgcaagctccgcctcccgggttcacaccattctcctgcctcagcatcccgcatagctgggactacaggcacccgcccccacgcccggctaattttttgtatttttttagtagaggcggggtttcaccatgttagccaggatggtctcaatcttctgacctcgtgatccactcgcctcagcctccaaagtgctgggataaaataaattcttagggccgggagcggtggctcacacctgtaatcccagcactttgagaggccgaggcgggcagatcacaaggtcagaagatcgagaccatggtgaaaccccgtctctactaaaaatacaaaaaattagctgggtgcagtggcgggcgcctgtagtcccagctactcgggaggctgaggcaggagaatggcatgaacccggaaggcggagcttgcagtgagccgagattgcgccagtgcactccagcctgggcgacagagtgagaccctgtctcataaataaataaataaataaataaataaataaattcttatacccacttgcattatttattattattattattaaacagggtcttgctgtgttgcccaggttggagtgcagtggcgtgatcatgacctcccagtctcgacctcccagtttcaattggtcctcccttctcagcctcctgagtagctgggactacaggtgtgcgctgcatgcctggctaattttttttttttttttttttttgagacagagtcttactctgttgcccaggctggagtgccgtggtgcaatctcggctcactgcaacccccggctcctggattaaagcaattctcctgcctcagcctcctgaatagctgcgattacaggcatgtgccgccacacctggctaatttttgtatttttagtagggacggggtttcaccatgttggtcaggctggtctcaaactcctgacctcgtgatccacctgccttggcctcccaaagtgctgggattacaggtgggagccaccgcgcctggcatgcctggctaatttttaaaaaatttttgtagcagccgggcgcggtggctcatgcctgtaatcctagcactttgggaggccaaggaggtcgggagttcgagaccagcctgaccaacatggagaaaccctgtctctactaaaactacaaaattagctgggcatggtggcacatgcctgtaatcccagctactcaggaggctgaggcaggagaattgcttgaatctaggaggcgggggttgcagtgagctgagatcgtgccacggcactccagcctgggcaaagagagtgaaactccgtctcaaaaaatttttgtttttgtttttgtagcgacagggtcttgttttgttgttgcctaggctggtactgaatttccagcctcaagcgatcctcctgcctcagcctcccaaagcgctgggagtacaggcgtgagtcactgtgcctggcctccacttgctttggctgcctttctctgtcttaggtaaccatacatttctccaggtaattaagaaaagattgcgcatgatgagtcccttttctggtatttctgggattgcccccaaaaccagacaagtgttcttaccttgacattttattaagactttaatgaacagaatgccgtttgccctcagtctgctggtccccctgcgaaggcccagggcttccttgtttgaaaagtcatccccttgtcgaggtctttgattccttttcaccacggcagtcatgccgagggtccacagagccaccccttccccatctcttcctcggcccctcaagacgcatctgtacccccggagatgtctctttgttttcttgggccacctctcctggccgtcactcaccctgctgactcattacttgtgcaacagtttcttctggaaccctcaggctcctgccacctaccctctgcagtccccgttttgttcctcttgcctcagtcttcctccccatcacccctctacctgttggtctccatctctgtctatggcacatccctgtgttatactctgatggctggataaaggttgagtgaaacgcatctacccctttggtgactggggtgcccattaatcagaagggatccaaggctggcgtagccttttcccgcatcctggggtatcgtcctgtggctcttccttgttggagtctgcagttttttgtttttttttttttaaattttttgagatggagtctcgctctgtcgcccaggctggagtgcagtggtgagatcccagctcactgcaacctccgcctcccgggttcaaccaattctcctgcttcagcctcccaagtagctgggactacaggcgcccgccaccatgcctggccaattttggtatttttagtagagacggggtttccctacattggccgggctggtctcgaactcttgacctcaggtgataggctcgcgtcggcctcccaaagtgctgagattacgggcatgagccaccaggcccggccgttgagattaccttcataagccaccaggcctggctgtagttggcagtttttgaccactggtctcgctccacgtgatctgtgatcttccccttggccccctggccctgccctgttcatctgctcacctttctcatgcatgcggtttgttcatagggtatgtaatggggtctaaccaggaaatggaaaccgcttgagcatttatttatttatttatttatttatttatttatttatttttcccaagacaaggtctcactctgtcacgcaagctgaagtgcagtggtgtgatcacagctcatggcagccttgaactcctgagctcaagcgatcctcccttctcagcctcccaagtagctcggactataggtgcacactatatgcctgcctaattttttcttttatttttgtagagacagggtcttgctttgttgcccaggctggtcctgaactcccaacctcaagcaatcctcctgcctcagcctcccaaagtactggagctacaggcatgtgccatcacgccttgctaatttttgtattttttgtgtgtgtgtaaagacaaggtcttactatgttgcccaggttggtcttgtactcctgggtttatgtgatcctcctgcctgggcctcccaaagtgctgggattacaggcgggagccacagtgcctggtccacttgagcatttagaacagaaggacttaaaggcggggaactagttacacagatgatgggagaggtgaaggccagacagggaacagagaggcaatcagcaggaaatcaaagtggtgtgggcttatacagccctctaaaggtatggatgcaatgattcatttagaatgagaaaataaataacagcaaattataaattataagcagctgttaaatatcacaaacatcactacatgcagaagagtaccagtcaactgtcagtcatatctccaaagttctatttctcccacatttttggcattacttcttcaatatgatgactttgtaatatcgttttctatttcgagaacagaaaactgatcaggctggacacagtggctcgtgcctgtaatcccagcactttgggaggccaaggcaggtggatcacttgaggccaggagttcaagaccggtccgggcagcgtggcgaaaccccgtctctactaaaaatacaaaaactagcagggcatggtggcatacacctgtagtcccagttacttaggaggctgaggtgggaggattgcttgagcccaggaggtcgaggctgcagtgagccgtgatcatgccactgcactccagcctgggtgagagagtgagaccatgtctcaaaaaaaaaaaaaaaacaacaaaaaaaaacataggctgggcgtggtggctcacgcctgtaattccagcactgtgggaggttgagatgggcggatcacttgaggtcaggagtttgaaaccagcctggtcaacatggtgaaaccccatctctaccaaaaacataaaaaattagccaggtgtgatgacgcacgcctgtaatcccagctacttgggaggctgaggcaggagaatggcttgaacccaggaggcagaggttgcagtgggccaagatcgtgccattgcactccagcctgggcaacagagtgagactccatctcaaaaataaataaataaataaagcgaatgaatctccttagttgatcaaattttgtttttatttttggtagttgggatgtatacaaaagtggcggtcaacatggagttggtggtgctgctacaattgttttgttcaagatacacaggaattctggtaaatcctgtttttttctttttttttaaatgtgattcccatcaagaaagaagtaggaaaatgggggagatttctaactgcatatgaggcatttgtgcatgtatttctgaccagagagacttttctgttttgactccacattgaaggaactgaatcctttgcttacaacttcacctctggtgatgggagtaattttccacagatttgcttctggacccgtgcatttcaaatcttgcttctctccactgcgcacgtttttccggcgccaggcaccgcaggatatgttcgtgtcttgtgatttttgattctgcgcggtaggtggaattggaacggtgagtggagcgagtattgctggaatccgtttccacaccgggatagcgagcagtaactgaactatacatggaaataaatgggaactacataaatataacccgaccaaagccaaactaaatatctttccagttcaacttctccttagcaggagcccccacgtggcagcaagcctccgtttccacctcacacaagagaaaatgtgacgggcaggaactcaagactggaaatgaacggggacgttaattgattgtagggaaaatattttccattttgtaaattttacaaaaaatgtttgaccctgtggacatgtggttagggcccttctcagtgccttgagagggaaccatgcaggtagagggagggttcttagcattgtgggggtgacctggagattggcagcagggtgccaccaccacccctaggtggggatgagagggaggaagtcctgtgaccagagtccaggggccagagtcacctgctgggagcccaaacaaaggtgggactctggcaggagctggaactacacagaggaccacctctcctgctggagaagctgtctgaggcagaggaggtggagagctcccgcgccctcccttgcttccacctcccaggttcctcccaagcctctcgttggttgaacccagcccaaagccagcaggcctggggacctggacacctgagccagcagaggtcggcgtttctcccacacaaaggagggcacaagaagtgggaggcacggagggggatcaggccaggacccacacaggatgtgcaaacaggagctcccctctcttcccaccccaaatggcatctgcagccggcctcacttccctgctgttagacaggaagaggaaccttgttcccggcaccagctgcccccaccgccccccaccccacggaggcccctttcctctctggcctttgcttgcaatcattggcgacgctgatggaccatatcttctggggagtttggtcatgaacatggtttcccatttgttgtggaccaaactgtgcccttccccttgaattcctgcgttgaagccctaactcccaatgcagctgtaattgaagatagggcttttagggaggtaattaaggttaaatgaagtcatagggcaggaccctaatctaataggattgatgtccttataagaagagggagagacaccagagatctctcctcccccctcacttgtaaacagaggaaaaatgacggaggacacagcagggaggtgggtacaagccaggaagaggggcctcgccgggaactaaccctgacggcaccttgatccgggactttgggcctctcaaactgagaaatacatgtctgttgtttaagtcactccctccacagtaatctggatggcagcctgagcttaccaaggcaccgtctgcatcagccagggctctccagggagacagccaataggagatggatggatggatggatggctagatagacagacaagcggacagagagagagagagacaggcagacacagacagacaggcagacaaatggctagatagacaagcagacagagagatagagacagacagacacaaacaggcaaacagacaggcagacaaatggatagatagatgatagatagccaggcaggcagatagacacagacaggcagacagacagacagacagatgataggttgggttcagtgactcttacctgtaataaccagcacattggtaggctgaggccggtggatcacttgaggccaggagtttgagaccagcctggctaacagggtgaaaccccatctctactaaaaatagaaaaattagctgggcgtggtggtgcatgtctgtaatcccagccactcgggaggctgaggcacgagaatcacttgaacctgggaggtggaggttgcagtgagctgagatcacgccactgcactccagcctaggcgacaaagtgagactccatctcaaaaagaaaaaaaagatagatagatgaatggatagatagctagatagatgacagatggatgataggtagatagataattgataaatagatataaatgaccgatggacaggcagacatagatacattgattaggtagatgatagatggatagatagaagatagatggtggatgggtgggtagataggcagatagacagttagaaagatagatgatagatagataggaaggaatttattaggggaattggctcataccattgtggaggccaagatgtaccacagaaggccgtccgcaagctggaggcccaggaaagccagtatcgtggctcagtccaagtctgcaggcctcaggactgggaagctgttgatgtaactcttagtttaaggccaaaggtttgagagcctggggaactgctggagaactgggagttctaagtccaagggcaggagaggaaggcatcccacctccaggagaaagagggaattcaccttttctctgcctttttgttgtctggcaatggaatggtgtcatccatattgagggaggatctttaccactcagcccaccaactcacatgcccatctcctccagaaacaccctcacagacacacccagaagcgatgcgttaccagccatcccttaatccagccaaactgacacctgccgtcagccaccacacaggctcagaagaatcgtggttgcatggtgatggtctccatcccgtctaaagaagttgaagatgaactgttggcacaagccatcgttctttcaggctccttccagtcgttcattcttttaaaaatgtattcattgagcacctgctgcatgccaggtgctgtgacaagcactggggcacagcagtgagcaaacaaggactcttgtttcttggagtttacatgcagtagaaggaaacagaatcaatgaattcatcagttctagaaactatcaaaataggactaagagctgtggtgagaattaagataaggtgattgcatagaaagtgactgatggctgctttggaatgagtggtgaggggtcacagagatgatgacagctgagttgagattgggaagacaggaaggagccagcagtgcaaggactaggctggaagcaagcttggtgcattccaggaacagcaaggaggccagaggggctgcagtagagcaggcgaggaggaggagggagacgcaggtcaaagaggagcctggggccagatggaggaccctccctccaaagctcagtcatttcctccttaaaggagaatgtgttacctccaaaagtcacatatgccagcacagtgtctggctcatcatatgccttcagtaggcggtgagcatggctgttcttgttattactacatcacaattactaggaataatggagtcaccaggctttgcatttacagcaatgtgagggagtcagcaagcttccctggggaacccatctcccctcactaagttcataagagcctgataaccaggtcaatgtagtgagagctatagctgcccagtgtactggactctttagccacgggccaggacactttcatctcagcagaaacctctaaggggactggggagtgtgctgtggatgtttctgggttactcagacctcctggggagccttccccaccgcagctgctgcagggagctcagctgcagtgatgaactgcggctcagccttgtttatgggaaaaccctacatgggagatgggacggtttcctgttggttctctcggcctcaggttgctttcacaagtgcagggattctcacctgggtgtgtgaatggggctcaggatgccccaagggtatgtggagatgggggtcagctgtcttctctgatgcctctgaacctcctccccctgcctttctgcatctcattgcttcctggcctctctcactttgggtgctttggaacaacatgcaatccaatacacaggctgactttattattttgttttgttttattttattttattttggaaacaaaggctctgtcattcagcctggagtgcagcggtgcaattgcaactcactgcagccttgaacttctgggctcaagtgattctctcgcctcagcctctcaaagtgctgggattacaggcatgagctgctgtgcctggcctaggctggctttaaaagctcctcactctctctgcatcctgatgatacctacctcctggagcaggctcccagccattggcttcggatactttgtagctattattggccagttgtggcatgtgaagctgaggctcaggagaagggcagtcctgtccaaggccacacggctcagtgctaacactcagacttcagtgtttttatctccctcctggtcgcttccacccttagtgcatctctggaggcccaagggagctaaaggccaggctttggtcagctaagaatttaaaaaagctgtctctgtgctcctctgtcaatccatcactccattatctcccccgacaatgaattcagtttgaatttcagataaacaaggattaatttttagtataagcatatcccacaacagacttgggatatacttatgcctaaaaatgattcattgtttgctggccttagtagctcatgcctacaatcccagtgctttgggaggctacagttggagaattgcttgagtccaggagttcaaggttacagtgagccatgatcatgccactgagctccagcttgggtgaagcagcaagatccttatctcttcaaaaaattgttgattgtttatctgaaatccaggtttaactgagcatcctgtattttatatgagaaccctatataggtgagacccagagtcccaatgcccactggtaagcctttgcagggaggctctgtgggtccttggctggcactgatgccctgtgatgagcagggccatctggcaaggtggacgcctgctgcccatgcaggcagagcaaggccctgggcaggtatgagctgatctcaccttccccagcctgggagccagatactgttggcagcttgccgtcaagagaggggctggtcaccaagagaggggcggcctccatgggccttctttggcttttggctctcccccagccctcctcctaccccaaacagaggccaacggcaccgcaccagaaccagtgtgctgcctcctttggttggcattttgtagttgggtagactgtttccttctcacaggagctggtggtgccccttccgcttcacagggaggatggctgagacccctgaccttgacacagggtgctgttctttttttgttttgagacagagtcttggtcttttcacccaggttggagtgcagtggcatgatgttggctcactgcagcctccacctcctgggttctagcaattcttctgcctcagcctcctgagtagctgagattacaggcgtgcaccaccactgagaacaatgccttctacagtgtttattctcctgtaggagcaagttcctaaggcaaggaggttgctcccctcatggatgaataaattgactttgatccacagccccacgtgtcagccttgagggtggggaaaggttgttctgtgtctaggcagggggtgggggcaaggccaggagggcctggtgcccagtgtacctcttcaggacacaactccaggtagcagaggccaaggacagaggggaggagaagagggaggtggccattatctccttatctcagcttcctttggagataagcttgagtattttagttgtccactaagtctggagataagtctggaatttaaacctttgactttgatccagcccttcacagctcctgtgagcaaactgagcctcagaaaaagggagtgaagcctgtgcatcctggacgcccccaccccaggctcaaaccgcccccaccccaggctcaaaccgcccccatcccagctcaaaccgcccccatcccaggctcaaagcgcccccatcccagctcaaagcgcccccatcccaggctcaaagtgcccccatcccaggctcaaagcgcccccaccccaggctcaaaccgcccccatcccagctcaaaccgcccccatcccagctcaaaccacccccaacacaggctcaaaccaccctcaacccaggctcaaagcacccccaccccaggctcaaagcatccccaccccaggctcaaagtgcccgcaacccaggcttaaagcgcccccaccccagctcaaaccgccctatcccaggctcaaaccgctcccaccccaggctcaaaccacccccatcctaggctcaaaccgcccccaccccaggctcaaagtgggaaggagccacagggaaacaaacgggggaggcacggatgaccaggatgagggtctccatgacccacctttccccaggggctatctcaagagctttttaaacttttattattttttaatagagatggggtcttgctgtgttgcccaggctgatctccaactcctagcctcaagccatcctcccacctcagcctcccaaactgctgaggttacaggtgtgagccactgcacctggcctctctcaggagtttcaagaaaaaaaatgggaatagatttgtgtgtgtgtgtgtgtgtgtgtgtgtgtgtgtgtgtgtgtgtgttttgagaaagagtttcgctctgtcacccaggctggagtgcaatggcacgatctcggctcactgcaacctccgcctctcgggctcaagtgcttcttctgcctcagcttcctgagtagctgggattacaaacatgcaggctgattttgtattttcattagagacggggtttcaccatgttggtcaggctgatctcgaactccggacctcagatgatttgcctgccttggcctctcaaagtgctgggattacaggcctgagccaccgtgcccggccaggaatagattcttttctgtagatgacttctgtcattattgaaaatggatgtttatgcacaattgaattgtcataacgcctcatcctaaaaagctcctttttgagaaaatgtgacttttgatagaggagagactgtccaggcctcattcattgtcagcacaaaggcagagcaggggtgtggcggtgtcaccctcctctgagacagccccatccctgctctgcccaggggttcagaagtctggtctattcgagcccacagaggggtttggagtggctgtcttacatcacaggtggggtctgtaaggatctgaaatgacctttgagaaggcgggtgtggtgggtgcatttcaatcattaaagtaacaacaatgatacatcaaatagtgtctgctcagattctgagtgcctgtttaaacatttccatcttgtgacttgccagattctagcataacaacccaggtaaaagaaaaaatagctgggcgtggtggcttgtgcctgtaatcccagcgtgaggccaaggcaggaggattgcttgagaccaggagtttgagaccagcctgggccacctgagaccccacctctgaaaataaacaaaccaataaaagaccttcatgctctatgtctttcttatatctaggttccccaaattatatgcattggggaaagtccattaagagaagcccctggccgggcgtggtggctcacgtctgtaatcccagcactttgggaggccaaggtgggaggatcacaaggtcaggagttcgagaccagcctggccaacatggtgaaaccccatctctactaaaaatacaaaaattagccgggcgtggtagtgcatgcttgtaatcccagctacgcaggaggttgaggcaggagaatcacttgaacctgggaggtagaggttgcagtgagccaagttggtgccactgcactccagcctgggcgacagaaaaagactccatctctaaataaataaataaagggagagaagcctctgggctcctagatacatgggtcagtgtccacccctgcaaagctgctgtgcccaaagaggggctgtacttggtggaattggggcaaaagagcagggagggcactgggcagttgacctggtctccactactggaaaggggctgtgctgctggtgccctgagctggttccacaaggaagacactgcacagggcgccctaagtttgctctttctgcctaggctcaccctttcctctccaggaccagggagccccgctcgtctcctgtcttcggcatctgctctctggcttgtgagcactgcatttctttctgcttggaacgccggcccatggtgggtccccggactcctgccttctgctgtcttttgccatatctcgtcaaagtgtgttttatttatttattgttattattttttgaaacagagtcttgctctgtcgcccaggctggagtgcaatggtgtgatctcggctcactgcaacctccgtctcctgggttcaagcgattctcctgccttggcctcccgagtagctgggattacaggcgaatgccaccacgcccggctaatttttgtatttttagtagagatggggtttccctatgttggtcaggctggtctcgaactgacctcgggtgactggcccacgtcagcctcccaaattgctgggattacaggcgtgagtcaccatgcctggccaactattataatattgatattataataatatcacagccagataacggtgactaacgcctgtaatccgaacactttgggaggctgaggcaggcagatcacctgaggtcagttcgagaccagcctggccaacgtggtgaaaccctgtctctaccgaatatacaaaaattagccggagcgtgatggcaggtgcctgtaatctcagctacttgggaggcggaggttgcggtgaactgagatcgtgccactgcagtccaacctgggtgacagagcaagactccatctcaaaagtagtaataataataataataataataatatcacttattgagttttaattttgtgccaggcactgtgctagtacttgcgccatgtgacctcattgactcggaacaacctatgagtaagcaccatctctgtccccaaggaagctgagactcaggaaatggaagtcatctcccagggcccacagcaagggcctggcgaggtctgcgttcaaattctgatcatctgactccaggctttcctgcctcctttgcctcccaaaaactcaaatactttcatctgggatgactccagacagctagatttcaattgtcttctctccttctgagtatgttttattttaaaatcacataaagataactcacttctcaactggagccacggaatcgttagatgtcttggagacttttctagctacctctttgctggactcagacacaggcctgaataattaggtccaaggagctgaactggagccgctcgtggccagaggtcccttcctgggaacagcagtggcggcagcggctgcgctgagcctggcaatttgttcaagagcaggggatgctcaggctgcgctcgcccccttcttatgaacggtttgctttgcgtcttctctgtgccaagggctgccaggcaccagatgcccattttaggaaatcagaaaaataaacagtgtaaataaaacaaaaactccacccaagaaatctgagacagatgctgttttccccaccgtttctccacccccatgctgggtttggagagagtgggccagcatgtttcctacggataagaggccctggggtatttaacctggatggaacctcttctattttccttttgcctggtgctagggggcagaaggcaggggtggtgtccatctggcccagggaggaggatagggcagcctttgtcgccggcatcccctgcagagatgtctcagccagaagtgactccatcctcaggaacgtgtgtcctgttctttgctgggcggcccctccttaccccccattgtttccacagtggggtgtgctagatttatgggcagagttctggttcactctcagccccggacagcagaatgtcccagtagtgcactgatggtgtgtgcgtggggatgtgtggaacaggggatagtgaccccgtgtgcgttatatgcagtgcggcttccagtcgggtgtgtgaagggggtgctcatggccatcgtggaagtgagctcagctggggctggagggtccaggctcactgtatgccactcagcagccttgggagtggggttcatcctcctccccgctcctctcccctcctggtcctgggcagcccaccggagctgcactctgggccatctctcctggtcttaaggaggctgtcatttctgggaggcagatgctggcccttccatccttgcttcctggagatctgcgccgaggtctgcctttctgtctggagggactggccaggaacccctgggttttcctggtggggtttttgttgcttagcagtgagcagagtgagtgggcaccaagaggaggatgctgggtgaggtcacggacatggctggggcaggctgggggtgctggaggtgaattccgcagctgtgcgaccttgggcagtttgcccagccctgggcctcgcttcctcctctatgaaatggggcgggagcacctgcctgctggggttgtgggttgggtgaatcggagctaaggtacagctcacagcctgccgtcagaccctcgcaagcagaagtgggtgtccctgctcagcgtcctccggtccctccttcaaggctcagctttgtcctcatctcctccatgaagcctccctggttactccaggagtcacgacccacaccctctttggagccttgtgtcacacgcatttctcacggtgttgctttccctggaggatgggttcaactaaaattggggcccatctgggggttccctccagcaccagagaagctcaggcttagtagagatgggtaccctgtcaatactagttccgcgaaggatacactgtgctcattctgctgccagttgctgagtctggtgtcctgtagttatggaacatgtgtacaggcctgggctgctggacacgaaggccagatgggcagttcactctgcctccgctctgagcctttagaaacaagctggctgcacccatttccatctggtcacagtttaggagtggggttgtggaatggatggaaggaaggatgagtgggtgggtgggggggtgggtgggtgggtggatggatggatggatgatgggtggatgggttgatggatgggtggattaggtggacaggtgaatggattggtgggtgggtgggtgggtgaagggctgaataggtgggttgggtggatgggtggatggatgtgtggaggggtggtggggtggatggggtccatgggtgaatggatggatggatgggtgaatggagtaaatgagtgggtggatggatggatggatgctgcaagagcctttctggagggttccagggaggaactggcatctttgaccagcagccagcatggtgatcagatacagggaggtgtctgggtctgcctgatcccttatctcactgttggtgggactgggctggttatgtgtccctgaagctctctgaagggtggctgtatggcattgcccaggggacatccccagagtgccgtgctctacagcaatagggtggccgcctgtgctcccagggccgctcctcctggcagcctttcgggtttgcttggcttagcacctcagcaaatctcctcgagttaggacttgcctgccatgagcctctccaacaagcagccccaggccaaggcctgtgtgtgggcagagggagcgcatgccgcgggaggctgcattaatctgaggttctgtttttgttccctcctggggcaaaaggtaaaaatagcctgtcccactccatccccaaatccagcccggctgcacccagccctgggagtgaagggggctgggtcaggactgcccgtgagttgtagaccctggtgtagggaaaccctgattcataagacgggtggacatggaggaaggaggagactccgtccagcagagacacgcttgggtgcagcccagcttggagtctgatggacgtgggctcacctgtgtgcaactctcattcactgtgtggccacagggaagtgacactctgtggagactcagattccttatctgcaaaacaggggtagtagggcttgggggaggatgtgtgtgaaggtttggcccagggcccctccagcagccagacagcagtggctgtcatccctccagcgtccagggttacctgggggagtagggcctctgtccccagatgggccccgtttctggctctggaactcacagcaggagcaaaggcgaggacattcctggtgttaatcatccacccggagggagagcgccagtggccttgtgtgacctttgccctttgtctctgtctttaggaggcacgcggacctccagtggccggctccggaggcttggtgactccagtggcccaggtaggtggctcgctccgctctggccccacccagctcatgggtgtgtttgtgctggggtcccttcattctggtctgggacctgcctccccacctggcttccctggatgagtggggccacttgcccatttcccagggagacgcagtctttgacggctttggactcaggtggcttccaggcctgtcgacgctgccctgctggagatgatccttgtgggggcaggggcagccacccccaggctcagggagcaagcccgtgtgtgcgggacagaggagagaacaggagatagatagggctggatgatttggtttgagatgctgaggggacagatgtgccatggacaggtggctttggccgtgagcctctcggtgttggttcagtatctgtgggctccctgcaaccttgcaggatggaagatgctccaggatagagcagatacgtccggtgttatctaggaggaaataagtgggcctctggcagtggtcactgtgctactccttgtgctttttccatgtgtttggaaattttccacactaaccagtagggaagggaaacagatgcacccatcagagctctggggctggccgtccaggacacgagttacagcttataggcttgaagggactctaccaacactgggtgcagcctgggcaagggagtgggacagagaggtcagggctctgcctccagcccttgccccccagggctgagtctgcgcgtcatcttctccccactgggtgtccctgatctcccctgcctgaccccagtgtggccatgctagtgcctctgtttctgggagcctacgttgttcttggctgtcacttccagcggccaggctgggacaggtgcccatctagtggcttttctatttggagaggatgatgggtcacagcaatgaatggacttacctcccctaggagacgaggagctctgagaagagcagagatggcgtggtcacctgtgcatatgtgctgggggccaactgggtgccagacccctggctgccatcatggtggcagacaggcagggactgtgccttcatgaattagccattctagaggagacaaagttaccaaaggacacggacccggagtcaaatccacacaaatagagcgcctgtggaccagggctgccttcagaacaaggtgagacagccgtcctgccaggacaaggcgcctacgggggcaagggcatgtgcccatctggagccgccacctccatgctctagaccagctccgtctaatagaaccttctgtgatggtgggtctgttctatacatctgcactccgccatcctgtatggtagccgcttagccgcctgggtctattgcacactcaaagtataaatgtttacgtttactttattcactcatttacttgcatagaattatttatttattttaaatggatttccacttatatctacgtgtggctagtggctatgaaactgaacagttccagaccacactggcacctgagacctcagaattctagacccaaagcctgcttctgatcctgagcttgcttctgtggggacagcacagacgcctcctaagtctgccttccagaggtggatgcagtgcccgtggactgtgcaccaccaggcctggacagtggagagggtggctttttacagggagtgggagtggaggggatgccgtgtccacattgagtgcatgtgaggccccttgcagtacaggatgggactgtatgtgggaagaggggggtgatgctctggctggaggcccctgggcagctgcatgattcagcgctgtggttaagaggggctccgcccatcgcagtcatgttgggcactaaccactggacagcccagccgctgctgtgtttctggggagcttttctccggctccgcatctgatctgcctctccatctccttccctctcattggccagcttctggtggaatgggtggggagggtcccccagttcttgtgggggttgcatcttgggaacctggcaccctgggctgcatggacacagcctcccccggcggttgcttccctctgctcagactggctggttctgtgctgtcagcacttggcagccacgatcacagctcagcttggaagcctaaggcataatttgctgaatcccaaagctgcaagctggtgatctgggtttgcgtgggactgcctgctgacacacggggtcctccctctgtgggcctctgtgggctctggcccgagacaccctttcctcatcttcttggcttctttctttctccctgcctcccttttgctaagaccctggtccaggcaggagttcattcctagacgccccagcatctccggcctccccatttgacactccccagacgactgtctgccatcccatcctcccagcccagcttctctgtagatccacatctggccaatctcctatgtctgggactcttgccctccccagaaggacgaaggctcttctcgaggttgtgtttgggactgggccagggatgacatttctggcaaaagcttaaatgacaccatgatcaacgctttggtcagctcacacactttctttccttttaaaaaaaaaatggaattcttagagctacaaaacaaaaatgtaaagaataaggtaataaaacacctgtgtactcaccatcccgcttaagaagtgagacattgcaggtgtagccgcagccctgggtgaccttctccatcctagccccactcctgctgcggtgcccgcccctctggattgggatctggccccgggcaggcacatctgtgctgggcagtggtgtgtctgagaagcctaggtctccttttttttttttttgagatagagtctcgctctatcgcccaggctggagtgcagtggcaccatctcggctcactgcaacctctgcctcctgggttcaagcgattcttctgcctcagcctcctcagtagccaggattacaggcacccgccaccatgtctggctaattttttttgtatttttagtagacacagggtttcaccatgttggtcaggctggtctcatacccctgacctcaggtgatccacctgccttggcctcccaaagtgctgggattataggtgtgagccaccgcatccggcctggtctcctcttgcatacggtcatcagcatcgtgtgactgagcagcctaggtctgtctcctcttgaatgccgtcatcagcatcacatccttggtgcctcactggagtcagtggctgccctgcctgtgcccacaacgtgacggcgtggagacttatccgtgtagatccacgaagccttggttcacttattttggcagctagcgagtgttcctctgtgtggggaggcagagtttgcccgtcccgtggcccactggtgacatcgccgaaggtcttctctgttactagtgctgccgggaacgtgtgtttccccaggtggatttggctgggctgtggagatgcgcttctcagcccttctagatgttaccaccacgccctcccgagtggccttctggtaggctctcccatgttcgctcattttctgtgcctcaggcagccgcctctctgactgagcgtccagcggacttttgccctgtttcccacggtgcacggagcatttcatctcagtggtgcctgagcttccctccctctggccctcagaccccggctgggatccttggagccaactcctctgcctgacatcccgtgtcgctaggtcctgctcttccatcttccaatacctctggggtgtgtggccttttccccagtgcccccatcatcccttctgtcctaggttgaaccgtgtcccccacaaactcatgtccaccaaaaacctcagaatgtgacctgggagttggagatggggtctttgcagatgtaagtagttaaggatcttgagatgaggtcattctggattagggtgggccctaaatccaacaactggtgtccttaaaagaagcagagaggccacagacacaccggggagagccacgtgaaggcaggagcagatgatggagtgacgcagccccaggccagggagcgtctgggaagaggcaaggaaggaccccccccccaccccaccccagagcctccctagggagtgtggccttgctgacaccttgattttggacctctggcctccagcatgggagagaacccgcttccattttttcaagccccacagctgtggtccattatggcagccacaggacactgatgcacctcccacctggccgctgtggatggacgaccccgcccgcaggaagtctccctcaagcactgcaggtgtctctgccctcacaggggacgcctgcacaagtaggtgtgaaaaaagggccctgtgggggcaaggcctgggctggtgctcgctgcctcccttcatcctatgctagttcccatgcctcttccggcaggagtgcctggctccacctggtgaatcagagccaaactctcctgacaattggctgtcacttatttaactgccaccatccccaggagacagaaaatgccagaagggtggggcctgtgcagtgcctcctcgctatttccccagggcaccgtgccacgttgcctcaatgcacagagtagctgctcaaagtgtgtcggacgaacaggtgccccatgcccagccatgcagacaaaagtgtgccacgtggagggagctggtcgtggaagagaccaccagcatcttggctgcccgaggaccttgcccctgggctcttgcaggcacccctagttcattacttcctctctcacccatagctacccactcttcctctatttctctgatatcagccttgccacccacccaggtttgcaagcaggaaatctcagagttgaccttgacctctgcctccccagcacccccaggtctcaacaggctgccaagatctcatcaactcgccctctgcatactgacccttggacaggctgccccggtcacggtcatgtcttggttgggcctccatcatccctccttggaccagcaggtgccatcctccccacccctgccctgctgtggctccttcccctccacggccaacatttagaggacgattaccacttccctccctgtgtgctggggaccgggtgataggatccctccacccgatcatttccattagacctgggccgggtcttcttactcatagagcccttagtttccgcccccaaagcctcgagggtggattcgtgctgccgcccagcctggccctgataccgctttccagcctggagccccctgcttctgcgctcctggctctgagtgctcgggccccccctggatgggttgccacttgtcctctggaaagcagggcttccatgctcctggacctcctagctgactcagtgactttgggccatcttgtcacaccccttctatcagcttggccttggttatttctgtgtcctccatagcctcggaccagagccacggcgggatgctttcctggtgcgtggcaggcagtcaggaaatattgctggactgaccttgataggagatgcttgggagaattgcccaaaaaactagcttaaaatgcaaatattggccttcttttgcgttggctaaagagtagcatttctccgtttgcctcccgggtaagaaattgatggcgaatgcaatgtctctagggaggagaagaaggtgacaaaaagggtctgtataacggggcacacgctaggcatttgtgactatttaagtttaaattataacataaatgcgaaactctttgccttggtagcccttccacattgcaagcgttcactgccacatgtggctgccatattgactacggcagatacagaacattgacatcattgcggagagttctatgggggggcgctggtttagatcatcttcacgttggatccacaaattcattgtttatccagtgaacggttactgggcacctactgagcaagcaggatgaaagacacccgctctcgggggagtcttccgttggctgcagagaagcttaaactcaggggacctggggcaaactctgcaagggcccttggcctctgcacccccagacctccctcgctctgcaggggcagtcgggggccccctctaggaatggagcgccagctccagctcctgtcaggctacagcccagatggttggctgagcacgagcatgtgagagtggaattgggcccaaccgggctgcttctccccgttgtcttggtttccttccacgctgacctggaaggactcctaaagcaacaggcctgcccaggcggtttgcaccagtaaaccctgcagcggccccaagggcagagatagctggattgtatttatttaggaacagccaaagtctgaggcacaataaaaagtggagaaagattccagagaggaatgcagctggcctcagcctgggaatccgtcttgcttgggaggctgtaggcgggccaggctggggccagcctggagggtcttggctggctctgctggcaggtacagtagcagggtcagcaggagggagtccaggacggagctccttcatttttaattcagggaagcaaacttcagtggttgagtctgaggatgagcaggaaatgaatggaaaagtcttttttttttcttttttctttctaggcagggtctttctctgtcccccaggctggagtgcagtggcacaattatagctcactgcagcctcaacctgccaggctcaagggatcctcctgccttagcctcctaagtagctgggactacagttgtgcgccaccatgactggctaattcttaaaagaaatgttttcaggctaggcatggtgacccatgcctgtaatcccagtacttttggagccgaggtgggaggatcacttgagctcaggtgctccagaccagcctgggcaacatgacgagaccccgtcttgactaaaaatacaaaaagttagctgggcgtggtggtacagccctgtagttccagctacccgggaagctgaggctgcagtgagttgtgatcacgtcactgtcctccagcctgggcaaagggagtaaggccctgtttcaaaaaaaaaaattttttttttttttgaggtggagtcttgctctgttgcccaggctggagtgcagtggcatgatcttggctcactgcaatctctgcctcccaggttcaagtgattctcctgcctcagcctcccaagtagctgggattacaggcatgagccactgtgcctggactttttttttttttttttttttttgtagagatgggatttctctatgttgcccaggctggtcttgaactcttggcctcaagtgatcctcccactttggcctcccaaagtgttggaattacaggtgtgagccaccacacccagcaggaaaagtcactttttaaagcgagaggttgtgcgtcctctatagcttggcgctcatcagcatggaggatttactggaacgtgtgttaggtgaggggacatggaagatggcagcaaatccgagcccagagcatcagaaagcatgctttcagccaaagatgcgttctctccacctccgcgcagcacccttccccagtgtgtactcctggagcaaggtggggccgatcctacgaagaccctttcccgaaggcccctgctgcccacatcagtgtcacctggaccgcctgctcccttttctggatggctggaccagccccagggcctcctggcctggtgtggggagcacagtccaccctggggaatgcctggtatgtgtcccctccccactgggtaccaggggatgaagctgtgcttcgtggaaggggacagaggcgctggtgcccaggatggtgcacctggggcggctgaactggacctggctcctactgggcccctgtggagcccagattgttgtgagaaggggtggggaaaggcaggtgatccgcacctttcacttttgtttcacatgggaacaggggcttatcctgcacacatattcagtttggagtatgaatttccatgaagaggaaaatctctattaggctctgatgtcaggattgtccgtgagggccgggccgtgttctggggcaaggacaggagtggagggggcaaccagggaaggcttcctaatggaggaggcatttgatagcatcttgaaaaagaagcagttcctaggccaagccagagactgaagaatgaccacctaacttcttttttttttttttgagatggaatctcgcgctgtcgcccaggctggagtgcagtggcgtgatctaggctcactgcaacctccacctcccaggttcaagcaattctcctgcctcagccttctgaatagctgggattacaggcatgcgccaccatgcccagctaatttttgtatttttagtagagacggggtttcaccatgttggtcaggctggtctggaacccctgaccttgtgatccacctgcctcggcctcccaaagtgctgggattacaggcatgagccactgcacccggccacgaccacctaacttctttctacaagatgccccctggctgacgcaaagcaggttgagtgagtgtgacacttccttcctgtctgtgggttccggcctttccagagcccggccagtgctattggagacaaagtggccttcgctcttccttcccgccctgccaggcccagcctgtgccgctgagccccactttgcaattaagaggagctgtgaaccagtgatgctgatgtcgcagaaaagtggccaggggtctatggggggtgaaggacagggatgccgccctgagaactgtctggaaggggcttttgggtaacagtgcccactccagggtgtgggcaggctggggtggctgggagctgggctcataggctggcacaaccagagtttcccaaagccgtgggcctgagggccctgccttcctgggacagcaacctttggtccaatttgggaaaaggtgggttaaaccaagcccggctccctcactgtaggattactcagtgcgtttagtatgcaaatgtgcctctgaatctaagacaggaccacagaaacctcttcagtgttcctctggagggagggaccgcgggggatccaccgcaggggcctgggtctgcactggcctggtgaagtgcccccttagtgcttacaccatgcgcggtgagaggttggccctcgcctcccccaccctctgctggccttacctcaccacctctgcactcgcctcccagccggctcatgactaactcctgcctcttcagagccaatcggtgctgccaggttttccatttcaagtgatcccccgcctgggccaaaatgtttggattttcaggcacggaggggagatggacctcaggccaaaccatgctgggtaaaactgagggtcaaggctgtgctcagcaagtgctccagccctggccgtcaaacccatagtgtgcacagcgtgcaggaggtggctgggtgaatgaactcagtcatagcccggcccctcactcggggctgttcccaagttcccaccgccagccaggctgggtcagagcctcgtggggccttcctgggcttccctgccccacagcaggagttcgtatggagagtctcgagtgaggttaatgggttttcttcctcttctttttttttttttttaatttgagacagggtctcactctttttacccagccagggtgcagtagtgcaattatagctcacagcagcctcgaactcctggcttcaagcaatccttccgccgcagcctcccaaagtgctgagattacaggcacgtgccaccttgcccagctggggtttctgctttttactttttctcttgtttctaaactcaatacaaagaaagatattacatttataatcagaaaaaccaacaaggaatattatttcaaaattggaaaagggattaaagaaacaaaccaagaaacctctgcgattcctgcccatcggagtcagtggttgttagtggttggcttaacacaatgttttaggaagaaatagaataacagaaagcaactccagtgagctgagccctggctccgtctgtggcgctgcatcagtttcctgcagctgctgtaacgagtggccacaagctggctgggtcacaacaacgcccagccatcctctcacagctctgcaggccacacatccgagatcagggtcaccaggctgaaatcagggtgtccactgggcatagccctctggaggctctagggcaggggttcccagccccgtgtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaaggccaggcacagtggcttatgcctgtaatcccagcactttgggaggccaaggctggcggatcacgaggtcaggagttcaagatcagcctggccaatatggtgaaaccccgtttctactaaaaatacaaaaattagccggacacggtggcaggcgtctgtagtcccagcttcttgggaggctgaggcagaagaattgcttgaacccaggtggcggaggttgcagtgaactgagatagtgccactgtactccagcctgggtggcagagcgagactctgtctcaataaaataaaataaaataaaataataaatataatacacttgaatcatctcaaaaccatctccccactccctggtctgtggaaaaattgtcttccctgaaaccgatcccaggtgccaaaaaggttgggggccactgccttcatcgcctgcccctttgagcctctggtggctgtgggtgtcccttggcttgtggctgcatggcccttaccttcaacaccagcatctacagatctctccgggccccatctccacttggccatccctgtctgtgtcaaatctccctctgcccccgtcttgtatgagcaccgagactgcctttagggaccacctagaccatccagggtgctctcgccacagcaagatctgcaactgaatcacagatgcaaaaactcttgttccaaacaaggtcccatttgcaggtctagggattaggacatgctatccctggggccattattcagccttctctcgtgactatgatccctcccttcctccccagcctcccacctcggctgagatgctgtccccacctccctcactgtctggctgcctgtggggctgtcctccaggctctttgggaggaggtggttgcttgatgtctcccagaaggctgggaatggtcctccccaccccccaggaagatgtcctttctgccaaggagattgcatttggggtcctatcccaggcagagagcggacgggactgtggcctgaagtggcacttcagggcctttggctctgtcatctagccgagggctgtgcatgggcctcacctggtcacaggtaactcacctggctctgtggggcagggattgtaaactcagaggcctgcggggtgtgtcgaggtagaggggtgcaaatattgtaaatttgttgggggccttggggagcagcacagactgaaaagtgttttgtctgaagagcagaactgtcttataccagccctgtgcggccaggcaggaaggcttccgtggtgcggccacgcgtcctccctttctcaacagaagctgacagtctggagttttcagagagattgcctgagttctcagccttggcacaaacacacattctctttaaacaggcttgggccaacagaaccagcctccgtgtctcgggtttgaatgaacccttgaggtgaagcttaaagacagagaggatgcccctgattcccaccccagggacccacattgtaaacccccacctgctctgctgagcccttggcctcagcatggaccctgaccatgtgctggtggggaccccccaggtaagtaagcagcctctgaggaccccggatgaacagtggggaacagcactgatcccccagtggggccccgagttcccggagaggaagactcgctccctcccaggggacggctagagactcactgactcatgcgtgtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggctcgggtctggggcggcggcgcttggacctggctggtggttggtttgtccactgtgtggtttgttttttgcttccagccaaagtctgtcttcaaggctgcctcggtctcctacctaaaatagcatttctgtgccttcctggcagttgattatagagggggaagctcccggcgctcagaggagcctggcgtgtgtgtgcacgtgtgtgtgcatgtgtgtgcgtgtgtccattcacgctggcagcccccttgccgcaggcacagacccatcagggcgtgaacaggcaaatgaagagaaagggggctcccctgcctttagttcaccccagctttccaggccctccctcccaggcccagcctccttggtcccttcactcacatgcggtgccgtggctgccatctcacgtggccagcgccgtcatcggtaattagcagtgatgacagtttctgccgctcatgccgccctctgagcccagcgctgggagacatggggtggctgagccaagctccaggctttgggtattctgaagtgacctacgggccatggagcgggaggtcgctaagagtgtcaacccctacgtgccttgggccctggtctgttggttgccactatgtgtgtgttggggggtccctgagaggcctgagagagggaggcccatctcggtggctcctctctaggacgtgtggtcccctccaccactgctcccagggccacatctttttttttttttttctttgagacggagtctggctctgttgcccaggctggagtgcagtggcgcgatctcagctcactgcaagctccgcctccctagttcatgccattctcctgcctcagcctcccaagcagctgggactataggcgcccgccatatttttttgtatttttagtagagatggggtttcaccgtgtcaaccaggatggtctcgatctcctgatctcgtgatccgcccgcctcagcctcccaaagtgctgggattacaggcgtgagccacggcgcccggcctcagggccacatcttgattgtcacgttgggactggtggagcgggtgtgtgttgtgccgctgagcacacccagtcgggcacagcaggcggacctcaggagggggccaggggagacggcagaaggcttgggtggcagtgaaactgcatcttatctgtttgagctcgggggctcaggcccgctgggacgggtgggtgtggagcccagcgtcctgctctccgcccagcaggagccgcagggcagggagcgctgagagggaccttcgtcaggcttgcacagtggagccgtcctcggagtgaccaccccaccaggcagcctgggcagaccacagtgggtcccctgcctcctgggccaccagccccaggaggacgtcactccacccgcctggctggcaggggcctcggggagcctcgggttcggccttcactttatagatgatctagccgaggcccagatgggtgaccagcaggggatctgagagctgagcagagaggcgtgggtttgggggtggtgctccctggggagctggaagtgatggcaccctcccaggctcacaaaacacgggcttttcatgaactgaacaaaacactctttgaaagcagccagtgctgtgccccagagaccactctgatccctgctgcccttggctgaggacagcacagccagggatgaagcggggacctcccctcgggctgtgccttgatgaaagatgctttctacaaaatcccattcggatgtgttttcatgtaagaaaacgtacatttttagaaactcagttgtaaactggctgccttccgaatgaacacgacagtcccggagctgtttcccttaatgaggttctcgtcctgggcaaactttagcgctggtctttaattgtcactgaactcccgcacagtccctggggaagtgacttccttcctgtccctgctgggtggccttgagcaagccacttggcagctctgggccgcagttccgtcatctgcaaggtgaggggtgggagcggcacggcccctaggcagcgcccccacctcctgcgggtttctgcgcgtgtcctgagttttgtgggcgcctcttccctcactgaggggctcttcttctctgcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctgtgggtgcctcatgccccactgggctggcgtgtgaggcgtgtccagctcaggctgccctacagctgcccaggaagggtttgtgggagggggtggtcctaccctggtgagtccacggtggtctgccagccccagggaaggcttaggagccccaagacctgccctcttgtccctccctcggcagtgtctggctccggtctggtttgtgaacgggggcctgggtactctcccgccctccctgggggctgtggccttcccctgggaaggtgctggagggtttgtcagcagggccggcatgagtcatggagtggtgactggccgctgaggcatggaaggccactccttccagccaagggtcggagctttttttttgttctggaacggctttgtggcttttacaaattaagcagttttatcttgttccaagagcttgtatttcagcagggagagagtctccaagaagggaactttccactggggagctctgttgggctgggaggctaggaacaggccacgagggagggctgcaggcaggggaagtggccgtctgtgcatggtcatgaatgcaggcccggggtcctggagggggcttggccacgctgtcgctggacgtctgtccccaccagggtccatctgatgcagtacggcacagggtaaagcccagctcctcttacggggttcctgggtcatcagtgggcggggaaccgaggcctcctggagggcggtgcctcagccctcacccctccctcctgtccctcgctgtgctgtccccgatggcctctgccatcccctgggagttcttacccctggacgctcggtgcctgtccggtctcaacctctccagctctgcttttccatctccgaggtgagaggcctggcctgacgcgctctgcacccgcttcctgcccagccccgtgggaactctggtccctgtagtggtttcctggggctgccatcaccaagtgccacaaactgggtggctcaaaacaccagacatttcttctctcgccgttctggaggccagaagtccgaaatcacggcatcagcaggcctggttctttccggaggctccgagggggagcctgcttctcgcctctggcagcttctggcggctcccgaaacccttggcgttccttggctcgtggccacaccactcgacctctgcctccgttgtcacggggcctccttctgtgccctaaatctccccctgtctgtctctcatacggacagtctttctcggatttagggcccactgggtaacccaaaatggtcccatctcaagatccttaacttcataacgtctgcaaagaccctttttccaaataggccatgttcataggctctggggtggatgtaaattttaggggccacctttcatccccctgttgtccccgtgtgtctggatgcacagcatggttccatgtcccagactccttgctggacccctctggccctttggggtggcctttggccttttccactcgtttctgtgctcctggtgaggtgtcggggtcgggcttagcccctgcaggaattctggggacagcatggagccggcaactccccaccaggcgtcttcctacctgcccagagctcatggttgtgaggggtctctccttgtggttttgatttgcaattccccagtggttagtgatgttgagcatcttttcgtgtttattgctcatttgcacatattcttgcagaaatgtctgtccaagtcctttacctgtgtttgatttggatgattgttgttgctgagtgttaggagatctgtagattaatatccagatactaatcccatatctgacctatgatttgctgccattccatggattgccttctccccacgttgttagtgccctttgatatgcaatttttttttttttttttgagatggagtctgactctgttgcccaggctggagtgcagtggcatgatcttggctcactgcaacctccgcctccctggttccagcgattttcctgcctcagcctcctgagtagttgggattacaggcacccgccaccacacccagctaatttttgtatttttagtagagacggggtttcactgtgttgactaagttggtctcgaactcctgacctcaagtaatccacccgtctcggcctcccaaagtgccggagttacaggcgtgagtcaccgcacccaggctgatatgcaaatattttaaacttctatgacgttccactttatctatttgttcttctgttgcctgtgcttttggcgccatatccaagaaatcattgccaaatgcaacgtcaggaagcttttcccctgtgttttcttctaagagttttgtggttttagctcttgagtttaggtctttgatgcaagttgagttgatttttgcatgtggtgtaagggctggtccagcctcatgctctgggctcttgattcacttctcttcttttctcacgcccagctggttccgctgggtggcggggaggagtggggaagtcccgggctgggcctgcactcgatcatcccctctcaggccagccagggagtctcagctcctgcccaggacctggctggacgtgctccctaccgggaaagcctgggccgtctttctaggctgatggcagggccagcccggggcgtcctgaggcctgccctgcggacatgccccttgttctaggtggtgtggctgcccggcctgcgtgtgagaccagctgtctgtgcttcaggccatggaggctgagtgtttccagcctgtccccttgctcggctctccctctggggaagcccctgcagcccattctctgcctccgcttctgccatctgtgcctttgtctgcttcctgtttggaggtggtcatccctggggccacccctcatgatctggacacaagtctccatcctgaagccaccacccaaacccctgtgcctcaaacccctcccacccaccacatgggtttccactgtgaccaactcagcagctgatgaagcttcccttggggctctcctagcaacggggagctggctttcccggaggcctggcctctccctaagtggaagtggggcgtgagggtgtcagcctttttctgctgcctggtgctctaggttggcttgtcacccctggaagcacttgccatccttatacagcaccccacacccacctccccgcctcctaccccttcttccaaggggtcatctctgcttccctccccacccaacctcacccatgtggtccgcccagcaacctttgacccccaacatgacaaaataaacctcccttgccggtcactcattcattcattcagcattgggtgctccctgtggacttggcgctggggtcccgtggaggacaaagccagacacagtccttgccctcatgggactgcacaagtgcaagaccacatcagtaaacgtgaaacacaggaagtgacaggtgtgacaaaggggaccagtggcaggacagaacctgcggttcgtaggaccaggtcaggagggctgcctcggggggacaccttcgggctgagcgcagaaggatgaggggagtaaaccaggctcaaacccagcaggcagaggcgatcgctgcaggcaaccggcaatgtgttcaaaggccctggggcgcggggggctgaggccggcagcacggcaggaagtaagactggggttgaaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggatgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgtaaaagaaaaaaaaaagaataaaccatagctgctgtagcaagttaatcctaccagcactggctctcatctgccgaccttacctctggcaatgcctccctctcctgggctcctgggacccctccggccccaccacccctcctgtagtggtctcgctggctgctgccctcaggttagtttatttttacccggcctgctcccaccaggggctgaggcctccttgctcactccagcttcctggcccgtctcttgctctgggcacccccccactccgaacggccagagcttctgaagccgctcgctgtgtgcccccgcctggccccatgcatcccgcacggtgctccccagggtctcccactggcaagggcattggcatagattctggggctgccttggttcaagcccaccctgacttggagcctgagggtccctgagggggtcctgaaggccagggcaggcaaggctggcatgctctgggcagtgggggctgggtatgggaggggatcgtgggtggggagattcctcttaaccagcggcccacgtttggagactgatttgggctccaggctacgccttgaaattgggacagagagtggcgcagatctcagcccggagactccctctgcctgtggacgccctcatacctccatccgtggagccaccctcctctttttttttctaaatggggaaactctgacttgaacactgaataaacaacacaccctcgaaatcagcgaagaggcactggctctgaaactttgccatgaaagcttgaaaatgctctttggaccgatttgctggaacagacgggtgtgatggggctgcggggtttcaggtggcaggaggcgtccccgtgcctagggcatcccgatgctcagagtttccccgtgcccagtgtgtccctgtatccagggcatccccatgcccagggtgtccccgtgcctagtgtgtccctgtatccagggcatccccatgcccagggtttccccgtgcccagggtgtccctgtatccagagcatccccatgcccagggtgtccccgtacccagggtgtccccgttcccagggcgtcctgtgcccagggtgtccccgtgcccagtgtgtccctgtatccagggcgtccccatgcccagggtgtccccatgcccaggcactgcctctccccactttcctaatctccctccaccaacaggtgtcagctgtgaaatgcctgctgtgtgtgtcctttggttgagttcatcttgtgctcttaagttcctgttagacacaggcaggctgctttagttcttctggcaaatgttttgttgttgttgtttgatacggggtctcactccgtcacccaggctggagtgcagtggcgccatctcgcctcactgcaacctccgcctcccaggttcaagcgattctcctgcctcagcctcccaaatagctgggatgacaggcgtccgccaccatgcctggttaatttttgtatttttagtagagatggggtttcaccatgttggtcaggctggtcccgatctcctgacctcaagtgatccacccagcttggcctcccaaagtgctgggattacaggcatgagccaccgtgcctggcccgtctggtgaatgtttattgaggcctactatgtgcagcccctctcttaggtgcttggcctgtaatgaggagcaacaaagacacagtcgctggtcgcttgttacttaacagttggaactgagaggcagtccacaaatgagcaaatccataggtggttttagatgaggactgtgaagaagctaagaacaggttgctgggggtgcatatctgtgtgtgtggcgaggggattaatggaagccctttctgagtggtgacactgagctgaagctgtaatgaccagaaggacccagccaggccaaaatccaagggaagagcaacctggcaaaggaaacagcaggtgtgaaggcccgaggctggagcctggggaaggtgggagtggctggagtgtgttttcagagacgggccatggtgacaccaatgcgacaggcagggccaggtcgtgccgggccttggaggccctggtgagggcttgattttattctcactatggtgggacctcagtgccctgtggctgctgagaatggccaggggcaggcagggaggcctgctagggaggaggctgctgcaggccctgcagctggagagggaggatcaggatctctttagagaggaagttggagagggaggatctctttgattgctggatggacccacctgcctggctgcccccgtcagcatccagcagaggccactggatgctgacaggtggccggccctgcccagccttgcactgccctgtgctgccctggtggctgccggctttaggaggagcgcttttggtgtctgagcccagtggtcctggctgtggtttggtacacttggccgtgggtgaggccaaggtggtttggatcctgggaaggttgggtacctggcagcctcaaggcaggagctggggtgttggaggaggaagcacgctcatccctcgttccttcctgtttcgtgggatgctgagtctctgggcagggacatggtgagccctggtgtgatgcacttaacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccctgggaggggtgagcaggacaagtgaggtctccagacttggggtggcttcggactggccaggcaggtgggtgggggctgcagtccatgcccccgctccaggcaacacagtcgagctgcagcccccgctccatccccagctggggctccctgtgctcaccttctgcttccttcctctccctcggaatggggggtggacactccaagactagcctcccagccactctccctgcctcctgcctcctctccttcgggacagacccctgtgatcgctgggtgttcctgatgctctgtcccctctgcgtcctgtgccgtgggtgagagagggcttcggggggacttccccctcttggagcacctgctgctccgggtgcctctgggggcgggcccccacctcacattgtggagctggtgtaggaaggaaggtgccgggagccagctccaattcacgtgctggctgtggccctcaaggtgtggatggcaggaggtggtgagacagggactcattgatcatgggactgacaccccctcatgttgatgtgggccctgagccataatctcaccagctcctgagttttggcgctgctcttggcgatggcgtggactcagccaggctctcgggcagcctttcctggattcttcctccgttctcccctgggcagtgtttctgttcacctggaaaggatgggtaggacttggagacaacagggattcaaagaagtcgggagtgggggcacctgtgcagctcaccctgcagaacagacaatttggttaaagcctaaagcctgctgtcaggagcctcgcttgcctctcagagagcacatggcttgaccatcacggggactgggggagaggcacaggcatgcctgtccggcagcagaagggaaccccgggcctgggcctctccattctgtggcgttgtctttcctcagagttgcactgtctccttcactgtccctgcctggccccagtgctcatgtggcttgtggccctcagtctgggcttggtctcccgcaattcaccctgcccagccccacacagcttgtccctccagctgggaatcggagctcacctggagtcccaggcagcagattcgatgcagtgatgcagggctgtcagccatgccagcaggccctgctgctcacagagggatgggtattgctgttgacaataattaaagaactacggcttcaggctgggtacagtggctcacacctgcaatcccagaactttgggaggccgaggcaggagaatcaattgaatccaggagttccagaccaggctgggcaacatagcaaggctttgtctttacaaaaaataaaaaataataataataataaaaactacagcttcagaatgattgacttcagcatgtttataaagtcaagggtcttcagtgtcctgggcctatgtcactgcgtcagagggagagaggaagaggctggggtgatgggcactggggcttatgctcctcctggaatgggtggtcttggactgtgcctgtgtgatatgtttgtcgagcgggggcggtgtccactgaggactggatgttgaggtgtgggtggggggaggttatgaagcactgggcatttcccgtgcaccagtgccccgagattgcagagaggggacccgcccagcctgggcagggaggcgggtggcagcgaggaaggggagaggaactcgggtgcagaaagcctttcctccagcaggtggcgccgcaagctctcgagagtccagctcctgcggggtttgcattttcactgaatttgtgggcagaggctgcctgggtgtagtttccgccaactgtgactgctcactgcgggcgaggggaagtggagtgcagagaatgcaccggagggcagatgaccagcccccgcacaggcacgggggtgcctccttccccgcacaggcacggggggcccgagcccttggggttcctgtcctaactgggcggggaaagggagggttggaagctgagttagggggaaagggggtggtctcctgccatctcttttattttatttttcctatttttggttgataggtttcaatcttttttacatttttccaactttttgccgtaaaacttttcaaacatagaaaagatgaaagagggctgagtgtggtggctcatgactgtaatcccagcactttgggaggttgaggtaggaggatcacttgagcccaggagttcaagaccagcccgggcaatatagtgagatcccatctctataaaggatacaaaaaattagtcaggcatggtggtgcaggcttggagtcccagctactcggaaggttgaggtgagaggattgcttgaacctgggaggttgaggctgcagtgagctgggattgtgccaatgcactccagcctgggcgacagaacaaaaccctgtctcaaaaacaaaacaaaacaaaaccacaaaaaagaaaccatgaaagattctaaagtaaacacccatgcacctaccacctagattccacagcaaccattttgctgtttgcttcaccacaaatccctctggccaccagcatccacgctggttttgatgcacttaaaataagctgcagaaatcagcacacaacatcctgtcaacacctcagtttgcatttcattaactagagtccggcatttgtctgtgattatttttgtttttctttgaagtaaaatgtatataccctgagatgcacaggtgtgaaacgttccgttctttgaattttaacaaaggtatccacgtgtatcccagcctgaccagaacatagaacatcactatcaccccagtaagttcctcatgcccctccaggtgcatcacagtccccaccttccccagggcaaccacaattgtgctttttttccaccacgaaataattttgccagtttgagtgtttcttagagctacccatgttgctgcaggtgccagcgatttgttctgttttattgctgagtaacgtccactgtgtgaacattctgtgggtttttagtcattctcttgttgaaagacccctggctgtttccatctggaggctcttatgagtaaacctgttacgctggttcttcttgtacaagtttttctgtgcatatgggcgttcatttattctgtagaaacacctagagtaggtatagggtaggtatacatttagttttataagaaactgccagatcttttcccaaagtggcccttccatttcacactcccaccagcaatggatacgagttctagttgctccacatcctggccaacatttggtgctgtcactctgtgaaatcttagtcattctggtgggcgtgtagtggtatcatctcattatggctttaatttgctttggcctgatgactaatgcggttgagcacattttcatgattggctcttcatatatttttcctttgtgaaatgtcttttcaaatctgttgctcattttaaaattgggttgcttgactttttcttctggatactgatcttttgtcagatacgtgttttacaaatattttattccagtctgtggcttgcctgttcattttctttcctttttcaagaacaaggtctcgctgtattgcccaagcaggtctgaaactcctgggctcaagctgtcctcctgcctctgcctccccaagagccggttttacaggcatgagccaccatgcccggcctgttcattttcttagtggtattttccaataagcaaaagtgtgtcactttaatttttatgaagtctaatttaacaaactcctttctttgtggttctctctctgtgttctttgtaagaaacctttgcctaccctgccaaattgcaaagatatttatgttttcctttagaaggcttagagttatatagcttttatgaattaacttttgcatatggtgtgaggtagagggtcagggttcattttgttgtcgttttatgtgtttattcagttgttccaaacttcatttttttttaaagcttttattttgtattttcttggtgacttatgaggtcgcacaattttccaagatccttgttggtcatttacgtattttcctttgtaaaattatctgtccacgtcttacttctttttaaaattatgttgtttcaagatcgagtgatttctgaagccttcattttataatgcttgaaagaatgaacaccttgttccccagctacaggcttctgctctttgtcctgcagctgcacagtggggtaagacttgggttttgttttgttgctgctttgttgtttcttcatttgactgtttccccatgggtctcatttaaaaaaaaaattggccgggcacagtggctcacgcctgtaatcccagcactttgggaggccgaggcgggcagatcacgaggtcaggagatcaagaccatcctggctaacacggtgaaaccccatctctactaaaaatacaaaaaattagccgggcgtggtggcgggcgcctgtagtcccagataatcgggaggccgaggcaggaaaatggtgtgaacctgggaggcggagcttgcagtgagccgagattgcaccactgcactccagcctaggtgacagagcaagactctgtctcaaaaaaaaaaaaaaaaaaaaatgttgtttcatatgttttttatatattctggatataagtcctttatcagatatatgtatcataagtttttttttccacattgctcctttccttttggttttcttaatgatgttatttaatgagcaagagtattttgttttcataaagtccaatttatcaactttttccagtttcgatttatgatttttgtgacctatggaggaaatctttgcctacactaaggtcaaaagaagttctcttattttctagaaattttatagttgtatattctatgattccttttattttttaattttttaaatttttacattttttaacctattatagccgtcaggatgttgtatgatccattttaaatcagtttttgtatttggtttgaggtcagggttaattcttgtttttctatactcatatccagttctagcaccgtttgttgaaaagacataccttactctattgaattacctgacacctttgctaaaaatcattgactgtatatgtggccctatattagtatatgtacgtatatacatgtaggccctgtgttgactgtatgtgtggtcctatattagtatatgtacgtatatacatattggccctatgttgactgtatatgtggtcctgtattagtatatacatatcagccctatattgactgtatatgtggtcctgtattagtatatgtacatatatacatgtaggccctatgttgactgtatatgtggtcctatattagtatatgtacatttatacatgtaggccctgtgttgactgtatatgtggtcctgtattagtatatgtacatatatacatataggccccgtgttgactgtatatgtggtcctgtattagtatatgtacatatatacatgtaggccccatgttgactgtatatgtggtcctgtattagtatatgtacatatatacatataggccccgtgttgactgtatatgtggtcctgtattagtatatgtacatatatacatgtaggccccatgttgactgtatatgtggtcttgtattagtatatgtacatatatacatgtaggccctatgttgactgtatatgtagtcctatattagtatatgtacatatatacatgtaggccctatgttgactgtatatgtagtcctatattagtatatgtacatatatacatgtaggccccatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatatatatgtggtcctgtattagtatatgtacatatatacatgtaggccccgtgttgactgtatatgtggtcctgtattagtatatgtacatatatacatgtaggtcctatgttgactgtatatgtggtcctatattagtatatgtactgtatacatgtaggtcctatgttgactgtatatgtggtcctatattagtatatgtactgtatacatgtaggccctgtgttgagacactattgtgttttcttgatattttgtccattcctttgctgatgccacatcttgattaatgtggctttacagtaagtcttaatataaagtctctcaaatatctaaaatattactttgaatattctaggtcctttgagtttccttataaatttaagaagtagcttgttgatgtctacaaaaatgcagtgtgaattttggttgagattgtgttgaatctgtagatcaattaaggaagaattggcattttaacaatattgagtcttttgtatagatggtatatctccgttttaaaggtccttttgtatttcttttatttctctactgaaaaaaaatctctacagaattacattgttttgtagttttcaagaaaaagatcttgcatgccatttgttaaatttattcctaagaattttacttttggcactattttaagctgaaatagattttaaatttcatttttaattatttgctgctagtatgtaaaaatacaatagatttttgtatgtaaatcttatatcctatgatcttttccaaagtcatttattactctggtaatggttttgtaggtcttttaggatttaaatacatagttttacttctttctgatcttgatgccttgtttttttttcttgctttattgcactggttagagctgccagttcagtattgaatagtagtgattagtggacatccttgcctgtgccaaacttataatgttaactttagatttgtcatatatgacctttgtcagattgaggaaattcccttctattcttaatttgctgaaattttttaacatgaatgggtatgattttagtaaatgctttttctgcatctatggaaatgatcattgttttgtcttttattcgtttaataggataaattacaatgattgatttttgccccccgttttttttttttttttttttaaagaaacagagtctcactcttgcccaggctgtagcacagtggtgccatcgtagctcactgcagcctgaactcctggacttaagcaatcctcccacctcagcctcctaagtagcagggactataggcacatgccaccatgccaagctaatttttaatttttaaaattttttgtacagatggggtctcattgtgttgctcaggctggtctgcaattcttgagcttaagcaatactcccacctctgcctcccaaagtgctgagattacaggtgtgagccactgtgcaggcctgattttttaatattgaaccaaccttgcatttctggaagaagtccaacttgcttatgagatatcatcctttttatatattgctaaatttgatttgcccagtttttaaggatttttgcgtgttgattcatgagggatattggtgtggtattttctttgtttgttagtttgtttcggtaatgtctttgtcagcctcattttggcttcataaaattagtttggaagtgttcccttctctttgttttctgtgttttcataaggttgatgttgtttcttccttaaatgtttgatagaatccaccaagaaaaccgtctggacctagaattttctactaggaaaggtgattgtttgtttttaatcacaaattcaatttaatgtatagaaagagttattcaggtttttttacttccccttgtcttacttttggtaagttgtactttgaaggaatttgtccctttcaggtaagttgttgaatttactcatttaaagttgttcgtaatacaagcatacctagggtttgcttccagacctcggcaataaagcaaatattgcaataaagcacgtcacacaaactttttggtttcccagtacatataaaagttatgtttaggccaggcatggtggctcatgcctgtaatcctagccctttgggaggccaaggtgggcggatcatttgaggttaggagtttgagaacagcctggccaacatggtgaaacctcatctctattagaaatacaaaaattagctgggtgtggtggcacatgcctgtagtcccagctgcttgggaggctgaggtgggagaattgctcgaacctgggaggtggaggttgcggtgagctgagatcacaccactgtactccagactgggtgacagggcgagactccatctcaaaaaaaaaagaaaaaagttatgtttacactatactatagtctattaaagtgtataagatcattatgtctttttgctaaaaaatgctaataatcatctgagccttcagcaagccataatctttttcttggtagaaggtctgcctcaatgttgatggctgctgaccaggtggtggttgctgaaagttgaaggtagctgtggcagcagtttctttgtttcttttttctttttctttttttttgagacagagtcttgctctattgcccaggctggagtgcagtggcacgatttcagctcactgcaacctctgcctcccgggttcaagcaattctcctgcctcagcctcccgagtagctgggactacaggtgcctgccaccacgcctggctaatttttgtatttttagtagagacagggtttcaccttgttggccaggctggtctcaaactcctgacctcaggtgatccacctgccttggcctcccaaagtgctgggattacaggcgtgagccactgcacctggccggcagtttcttaactgaagtttttgacatgggttgactctttctttcatgaaagatttttctgtggcacgcattatgtttgatagcatcttacccacaatagagcttccttcaaaattagagtcaattctttcaaccctggccacggattgatcaaataagttgatgtaatattctaaatcttttgttgtcatttcaacaatgttcacagcatcttcgcctggagtagatcccatctccaggaaccactttgtctgctcatccataagaagcaactcctcatctgttcaagtttgatcatgggattgcagcaatccagtcccatctccaggctccacttctaattctagttctctgctatttccaccacatctgcagtgacttcctctgctgaagtcttaaaccgctcatccatgagggttggaatcaacttcttccaaactcctgttaatgttgatatttcaacctcttcttgtgaatcacaagtgttcttaatggcatctagaatggggaatcctttccagaaggttttcaatttactttgcccagatccattagaggaatcactaactatggcagatactgctttataaaatatatttcttaaataataagacttgaaaatcaaatttatcccttctccatgggctgcagaatgggtgttacattagcaggcatgaaaacaacattcatctttacatacatctccgtcagagctcttgggtcacaaggtgcattgtcaatgagcaataatattttgaaaggattcttttttcctgagcagtaggtctcaatgatttttttttttttttgatggagtctcgctgtgtcacccagaatggaatgcggtggcatgatctcggctcattgtaacctctgcctcccgggttcaagtgattcttgtgcctcagcctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagccactgcaccgggccctatttgttttttttttgttgttgttttttaattgagacagagtctcgctttgttgcctagactggagtgcagcagcgctatctcagctcaccgcagcctccgcctcccaggttcaagtgattctcctgcctcagcctcctgagtagctgggactgcaggtgtgcactaccatgcctggctaatttttgtatttttaatagagatgaggtttcaccaccatgttggccaggctggtcttgaactcctgaactcaggtgatttgcctgccttggcctcccaaaatgctgggattacagctgtgagccaccgtgcttggcccttttttgtttttttgttttttttcaaattgagacagagtctccctctgttgcccaggctggagtacagtggcacgatctcggctcactgcaacctccgcctcctgggctcaagcggttctcctgcctcagcctcccaagtagctggaattacaggcgtgtgacaccatgcctgaataatttttgtatttttagtagagatgcggtttcaccatgttggccaggctggtctcgaactcctgacctcaagtgatccccccgccccagccttcaaaagtgctgggattacaggcgtgagttgccgcaccaggcctcaatgggtttttaatattcagtaaaccatgctgtaaacagatgtgctgtcaagtagggcctgttattccatttctgaagcatagacagaatagatttggcagaattcttaagggccctaggatttttggaacggtcaatgagtattggctttaacttacggtcaacagctgcgttagcctctcatgagagtcagcctgtcctttgaagctttaaagacaggcattgacttctcccctctagctatgaaaatcctagatgacatcttcttccagtagaaggtgggacatctatgctgaaattctgttgcttagtgtagccaccttcatcagtgctctgagctagatcttctgggtaacttgctgccgcttctccatcagcacctgctgcttcaccttgcacttttacattatagagatggcttctttccttaaacttcatgacctgacctctgctagcctcaaactttccttctccagcttcctcacttctcttagccttcataccattgaagagagttagggctttgccctggattaggcttttgtttaagggaatgttgtggctgatttgatcttctatccagaccactcaaactttcttcatatcagcattaaggctgttttgctttcttcttcttcatgtgtgcactggaatcgcacttttaatttctttcaataactttttcttggcattcacaacttggctagctatttggcataagagatctcacttttgcctgtcttggctttcgacacgccttcctcactcagcttaatcatttctagcttttgatttaaagtgagagacgggtgactcttcctttcacttgaacacttagaggccattgtagggttattaattggcctaatttcaatattgttgagtctcagggaatagggatgcctgagcagagggagagagagcggggaacagccagtcagtggagcagtcagaacatacaacgtttattgaataagttcactgtcttatctggatgtggctcgtcatgccccaaaaacaactgcaataatggcattgaagatcactgatcactgggcgcggtggcccatgcctgtaatcccagcactttgggaggccgaggcaggtggatcacctgaggtcaggagtttgagaccagcctggccaacatggtgaaacctcgtctctactaaaaataccaaaattagccaggcgtggtggcgggtgcctgtagtcccagctactggggaagctggggcagaagagtcgcttgaacctgggaggtggaggttgcagtgagccgagatcacaccactgcactccactgcactccagcctgggcaacagagcgagactccatctcaaaaaaaaaaaaaaagggccgggcgcagtggctcacgcctgtaatcccagcactttgggaggccgaggcgggcagatcatgaggtcaggggattgagaccatcctggctaacacgatgaaaccccgtctctactaaagatacgaaaaaaatagccgggcgtggtggtgggtgcctgtagtcccagctactcgggaggctgaggcaggagaatggcgtgaacccgggaggcggagcttgcagtgagccgagatcgcgccgctgcactccagacagagcaagactctgtctcaaaaaaaaaaaaacaaagaaagaaaaaagaaaaaagagatcacagatcaccatagcagatataataataatgaaaaagtttgaactatttcaagaatcatcaaactcctacacagagacacagtgttaacatgttgttggaaaaatggtgccagcagacttacttgatgcagggctgccacgaaccttcaatttgtaaaaagtgcagtatctgtgaagcacaatgaaatgaggtgtgcctgtgttccttgtcactgtaatgtcggtaggatccgtaaggaaaacacttcattccttttattgtgactttatgttcgccatctccctctcatcagcagcctggctaggaggttatcaatctagatctttttaaagaaccagcattggactccccttttctggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcctgggttctgtgagtcactcaagcaaattattgaacctgagaagggagttgtgaagacctcaaatttgtagccaagtcagacagaagttatgggtaacctggtgtcttaccacttgcgactgatctctgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcttgggcgacagagcaagactgcctcaaaaaaaaaaaaaaaaaaaaaaaaaaaggagattctgacacatgctatagcatagatgagccttgaagacatgctaagtgacagaagccagacatgaaaagacaaatactgtatgatttcacttttatgaggtccctagagtagtcaaattcagagagacagaaagtgggatggaggttgccagaggctgggggaagggagaatgaatgggaagttggtgtttaatggggatagaattgcagtttgggaagatgagatggatggtggtgatggttacacaacagtgtgaatgtgcttcatgccaccaaactgcacacctgaaaatggttaaaatggtaaattttctgtgatggatactttaaggcatgtatgcaaacacacagaagcagttactaccactggggttgatggaaaagaaaccaagaactcggagcgtcctccacaccttgccacgtcttacgttcaggccttgttggagagtgtgtgactgccacagaaacctgcagcctactggtaacaaaaaggttcttgccagaaggtgtagaaagagtggatctgcaggatcagcttactgggtagccgagaaacctactagagggtatgggtgggcaggagctgggtgtctgagaagtttgctgaggtcccattgggctagagctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgttttgttttgagagagcatcctgctctgttgcccaggctggagtgcagtggcatgatctaggctcactgcaacctccacctcccgggttcaagccattctcctgcctcagccttctaagtagctggagatgcccaccatgcccagctaatttttgtatttttagtagagacagggtttcaccatgttggccaggctggtcttgaactcctgatctcaggtgatccacctgccttggcctcccaaagtgctgggattacaggcgtgagctacactgcacctggcccatttttccagattcttaaagcagatccttaggtctttttttttttttttttttttttttttttacttcttttctaatataagcacttacagtttccctctaagcactagcttcagcctacgtattttagtatgctgtgttttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactacaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggttttatatcatgtattttgaagctcctttggttaggtgcatacacatttatgattataatggtgtctcgatgaactgatcatttaaccatgatgaatgtattcctttatctcgtaataattttatcttggactcaactttattgatatttatgtagcctctccagccttcttaaacatgctgtttgggatgcataagaaggctggagaggcttatggagaaacttatgatggtttgacttacagtttttcaactttaccatggtgcgaacgtggtatgtatacagtagaaactgtactttaagtatgtgtgaaaccattgtgtttctcactttcagtacagtattcaataacttacatgagatagtcaacactttattataaaataggctttgtgtttgttgattttgctcaactgtaggctgaagtaagtgttctaatcatgttaaggtaggctaggctaagctagaatgttcggtaagttagatgtattaagtgcatttttgagatgatatttattttccacttatgatgggtttgtcaagacataactccatcatcattcaagcagcatcagtatgtctttttccaaacagaaaatttcaacctgtgtttatactgaaacagcatcttttgtagatagtatatagttgagtcttgctattttattcattctgacagcctccgccttttaattggaatattcaggctatttctgtttaacatagttatagatatgactgggtttagagctactaccttgctctttgatatttatttctttcatcttgctttcttggcttcttttatgttaattaagtattttttagaattctattttaatttatgttttttttttttttttttttttaagacagagtctcactctgttgcccaggctggagtgcaatagcatgatcttggctcactgcaacctctgcctcctgggttcaagtgattctcctgcctcagcttccctagtatactgggattacagacgcctgccaccacggccggctaatttttgtatttttagtaaagacggggtttcaccatgctggccaggctggcctcgaactcctgacctcaggcgatccgcccaccctggcctcccaaagtgctgggattacaagcgtgagccactgagcccggcctgttttgactttttaattgtatctctttgtattgctattttagtagttactttatagattctattgcacattcttagcttttcacagtctacttagaattaacattgtttttcttcatggaaaaaaagtgtaagaactaggcaatcctatgggttcatttaccactttccatcctgtatgtgatggttgttagatatttactacatccatacacattgtaaactagacaatacaataaggaaatttttgctttaaacagccccatgcattttaaagaaattaaaagtaaaacagaatcttttctatttgcccatgtatttgctatatcctgtgctcttcattccttcctgaagagctgagttcccatctggtctcatttcccatgatcttggagaacttgcttcacggtttttgtagtgcaggtttgcagacagctaattccctttcattttcacttatctgcaaatctttattttgctgtcattctttctttttttatttttatttttatttttgagacagagtctcactctgtctccccacaggctacagtgcaatggtgtgatttcaaaactcctgcccaatctcaactcaccaaccttctcctcccgggctcaaacgattctcctgcctcagcctcccaagtagctgggactacaggcatgtgccatcatacccagctaatttttgtatttttagtagagatgggatttcaccatgatggccaggctggtctcgaactcctgacctcaagtgatctgcctgctttggcctcctaaaatgctgggattataggtgtgagccactgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctacctctgggcaaaaaagcctccagaaaccagaaacttatctagttttattcccctctgtcaggtgtagactctactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatgggctcacaaagctcctgcccgtggccctcagttggcagtggcctctctgccttgaagttgccatgagtgtgtaaaacctacaggctcaaccttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggcgggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacatggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaaatgaggtgactcaaaacatccgaaatcggccacgtgcggtggctcatgcctgtaatcccagcactttgggaggccgaggcggttggatcacgaggtcaggagatcgagaccatcctggctaacatggtgaaaccccgtctctactaaaaatacaaaaaaaaaaaaaaaattagccgggcgtggtggtgggtgcctgtagtcccagctgctcaggaggctgaggcaggagaatggcatgaaccttggaggtggaggttgcagtgagccgagatcgcgccattgcactccagcctgggtgacagagcaagactccgtctcaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgcagtggcgtgatcatggctcactgcagcctcagcctcccaggctcaagcaatcctcccacctcagccttccaagtagctgggacacaggcgcacgccaccatgcctggctaattttttaatttttttgtagagacgagggcccaggctggtctcaaactcctgcgctcaggcaatgagactttgcctcccaaaacactgggattagagacatgagctgctgtgcccagcctacctctgtcttataaagacacctgtcattggatttagggcccactctgattcaatatgccctcaaataacccaattacatcttcaaagaccctatgtccatataaagtcacattcataggtactggggggtcaggacttgcatatgtcttttgggggaacacaattcaacccacaatgggtctcacccacagaacgaacggcctctccagggtgtgcgcaggtgggtgaggggcccaggagagggacctgcgtggcaagagggcttgtgttcacgtcagagattccagaaggagactggatggggtggctgcatggagcaaggggctacagccactgtctccaagtagttggtgggttgtctggtagaaagggagcatttattttgagttcccccaagatatgaagctagtaccaggtacctggaaggtgctagcgagtagagcttgactctttacagaaagaggtgtttttctcacaatgttcacttgaggacggtggaacaggctatttcacaaggtagtgagttccccatgcctggaagcattcaagcaggggccatgtgggagttgttcaggagtgcatagaagggacctcagaggtccctgccaataccatctttgcttgtcttattttacgacaacttgaatttcagaatgtaatgttattggggatatgtctactagaggggcctccagcatcaggccccacacactatgcatcatttttagggcagggaatgagagcaggctccattctttttggttgtctgtgaggaccaggaggcttgctgctgaggcagcttcctgtggaaacagtgtctcagccccgcaatccattcatcggagctccaacatcttaatgaaacactgtgtcagatgggttctgggcatgtgtgtgcagattgtcacaagtccatgagaatgcacacacgcacattgcatgtgtgtgcacacatgtatgcacacatgcacaagaacacgaagacccgaggcaggtatagtccgtgagacagatccctctaggctgaaagactccccacaagggtccctagaacaaggctccagcctcggcagtccctcccacttctggtgggaggatctccacagagaagaagggtcaagaagcacagctcttgatgctcacggtgtaccaagctctgctttaagcttgtgtcttattttttacttatttagcaaatctgtcgctcttgttttgtgccagatgctgttctcagcactttacaaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgtgaagggctgtgcgtgtaggatttgtgcaaatgtgcccctccctgctgccagcccatgggaggctgtcaagattctgcccctgcacattagcccacactctctttgtggcccactgctgtggctgttcccttgtgtcacgtggctgcaggcacagcccccaagtggatggggatcgtgggctgaatgtgcatcagatgctcctgcttcttggtgggtggagaccctcaacccatgcaccgtggctgccgcatctgaaaggccttccatggtgaaggacttggacctgagcaaccctccgcagaggtcttagaagtgctccctggccgggcgcggtggctcacacctgtaatcccagcactttgggaggccgaggtgggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccaggaggcggagcttgcagtgagccgagatcgcgtcactgcactccagcctgggcgacagagcgagactccgtctcaaaaaaaaaaaaaaaatgaagtgctcccagctcttcctcctgtggtgaggttctgagtttccatcctcagaagaaaacctggctggggagggcatctctagacccggacataaacgccaggagaccagggctgccctctcaggtgaccaatcacagagactcagggaaagtcacgtttggaagaggcgacactgtgtctcagcctcattcatttctccatcctacagacactgcctggtgcccagcccgcaccgcgaggcttcctaagcagctctgggcaccgtgcacctggcatggcctccagccccatctccctgccttgggagacccggtggggactccgggctgagctcctgtggctgtggaaccttggtggtttattgtggtggctgagaacagggacgtggggttggacgggttgagtgtaactcccagtggctccgtgaactgcctgggagccttgggcagctctttctcactctgtgcctccgcttcctgatggaaaaatgggggccaggggggagcgaccttgaaggtattcgtgggaaccaagcgaggtgataaatgtagtgtccttggtagagaactggacacagagtccacccccatgaagggggctgctcctcctccttctatgtttcctcttgttcttatttctcctcttgtatcttctcttcctgctttccctccccctcccctccccccccacatgcaggcacactccatttggtgccccaactgcctttctccattgtccttctgtaagtggttctctaagtgggaactcaggcctggaaagggtgggcaccctgtctggtgggctctggcaggccaggcgctgagcagcctcaggagacacaaccctaggaaaaggctcatgcaggctggctgtcatgacggactgttggtgggagaggggaaggcgccgtggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaaacacatggtcaagttgaaagcattttacagggaacacattcagccatcacctagattctaccactaacaccaagctacacctgctttatcacctcaccgtccatctatccctccttcgcctggccatgaatccattttatttttattttttggtgcatttcaaagtaatttcaggtcatcctgattatctctggaatcactgtcagaaattccctcccttcccctcccctctcctttcctttccttttctgagatgggatcttgctaggtcacctaggctgaagtgcggtggtgcagtcatagcacactgcagcctccaactcccgagctcaagcaatcctcctgcctcagcctcctgagtagctgggaccgcaggcatccaccaccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctctgaagctcagactgttattttccagttccaaataccaaaactggctaggcacggtggctcatgcctgtaatcccagcactttgggagaccaaggcgggtggatcacttgaagtcaggagttcaagaccagcctggccaacatggtaaaaccccatctctacaaaaaatacaaaaattagccagacatggtggcgtgcacctgtagtcccagctactcaaggagaacccagctacccagctactgaggcacgagaatcacttaaacctgggaggtggaggttgcagtgagccgagatcgcaccactcctctctaggctaggcaacaagtgtgagactctgtctcaaaaataataaataaataaaataaaataaaaattaaaaccaaatgccaaaaccaacccacaaaataaaccttggttaaagtagcctgttcattttgctttaactatgtatattgcaccagattctgccaggggctcagcgtataaagatgagacccctgccctgccagacaggtgggatgatggccataccttgagttagtcaaggcaccatctggctgtgtaacaaaagctaaaacatcagaggctgagcagcactcggacccacgtcccagtccaagtgtcagtcgttatgggggcccaggacagcccggacctagttcattcctttggtgcatcctcgacacacagcttccatctcttgagctgagatggttccagctcctgccgtcatgtctgcactccagccagagggaagggaagaagggagaggggaaagggcaagtgtccctctttatttttaagggcatgacctgaaagttaaacacttcagctccttcccactggccagaacccagttgtatggccgctcctgtcatcagggaggctgagcaatgtattcttcagctgggcttccctgtgcacaaccaaaacttcagttactatagaaaaaagggagctcagatattggggaaacaactagcatctgtaccacatgcactgatagctctctttgtatgaacagagctgtggcaggccctatgccagggagaaagtaagattggaaaagagcttaccaaggaggtggcatttgcactgtgcttaaggggcaagaaaaacgtcttccaatcaggagccacaaatgcttggctgaagtgctactgctctttcatcctggagctggaacagacgtcaccagtcaatcatgatggctgctgggtgcactggctaacatctataatcccagcactttgtgaggctgagggtgggaagattgcttggggccaggagtttgagaccagtttgggcaaattgcaagaccctgtctctgcaaaaaaatataaaatgtagctgagtgtggtggcacctgtagacccagccccagctactcgagaggctgagatgggaggatcgcttgggcctaggagttcgaggctgcagtgagctatgattgcaccactgcactccagcctgggtgacagagcaggacctgtctctaaaaacaataaaataaaatcaaagttttaaaatggaaaaaaaatcatgagcacataactccagatgtatcctcaagatagcaaacccgggtgggcgcagtggctcatgcctgtaatcctggcactttgggaggccaaggtgggtggatcacctgaggtcaggagtttgagactagcctggccaacagccccatctgtactacaaatacaaaattagctgggcatggtggtgggcacctgtgatcccagctacttggaaggctgaggcaggagaattgcttgaacccaggaggcggaggttgcagtgagccaagatcacaccattgcactccagcctggagaaaaaaagcaaaactctgtctcaaaaaaaaaaaaaaaaagcaaacccagggccaggtctgtagccacatggccaccttcttccctgagcatggaggcagcctcagaaacctgccccacatcacatcagtgggcagttgattgggtcagcctgccagttgaaccctatttgccacagtcattctccatagtaaggggcattctagacataccccccttcccagggaagaataagccgtagctgcctgagcgttttatccagtggtgtgcatgtcttttcccaactctgtgtttagtgatgtcctgtttgtagcttgaaatttgccacagtgggtgtgtttacaccacaggaattggcaaacactacatatcaggccttacctcctgctccctactagggtaggttgttttttttttgttgtttttgttttttgtttctttttttttttgagacggagtctcgctctgtcgcccaggctggcgtggagtgatgcgatctccgctcactgcaagctccgcctccctggttcacaccattctcctgcctgagcttccagaatagctgggactacaggcgcccgccaccacacccggctaattttttgtatttttagtagagacggggtttcaccgtgttagccaggatggtctcgatctcctgacctcgcaatctgccctcctcggcctcccaaaatgctggcattatgccactgcgcccggcctagggtaggttgttagaaatgtaccagcctgccagtttcagccttgtttgtctttcatcctttttttttttttttttttttttgagacggggtctctctctgttgccccccaggctggagtgcagtggtgtgatcctggctcactgcaacctctgcctcctgggatcaagtgattctcctgcctcagcctcccaagtagctgggattacaggtgcccaccaccacgtccagctaaattttgtatttttagtagagatggggtttcaccacattggccaggctggtatcgaactccttacctaaggtgatccacccgccttggcctcccaaagtgctgggattacaggcgtgagccaccgcactgggcctctttcgttctttcttaatgaaaatcttcctgaaagatttgcctactgatgtctgtgtcaataggtactgcctgcgggacagagcctgccctccttttgaaggtctttctctgtctgggtgaccatctgcatgtcactccctgctgctcagaactaaagatgtagctatgcctggggtaggttgggaaaacctgtgggaatcacagagcttgctgtcatgctgtgttctggatacctgaagcttggcaggcaggtgggatcgagggtgggcattaggaaagtgatgtggctctataggaaggggacataggtcctgagattttaggtccccaattggacaaagctgttttttttttctggataaatgttctagcttattcataatcgagtggtcagttttcttttcttttcttttctttttttttttgagatggagtctcgctctttcgcccaggctggagtgcagtggcgctatctcggctcactgcaagctccgcctcccaggttcacgccattctcccgcctcagcctccggagtagctgggactacaggcgcctgccaccgcgtccggctaattttttgtatttttagtagagacagggtttcaccgtgttagccaggatggtctcgatctcttgacctcgtgatccgcccgcctcggcctcccaaagtgctgggattacaggcgtgagccaccgcgcccggccaagtggtcagttttctcagctgccgggtcttgcacaccttgctggctctggagaccatatgcaccatgtagaccccatttgtttcctaccctcagtgttgggggaggggccaagggcctgtcgatgtgttgacacctggccattcactggccttgaatgtccacattcacctccttgaaatcgatgccccgtatcggaggctccatgtggatttgggggcagaggcctgtactccagatggtggggtggccttcaccaatcaggcagattccctgccctgccctgccctttgggctctgtagctccagatgtgtgctcaagatctgtggccacatggatgggacaagccacagagactcagactccgtggtccctgtgaccagagtagccgtggccctgtctgggaatgttcccaccctgttgctgaaggtgagaaatttctctgtgctggagaacagctgtgctgagaagttggcccatctggcttgcaggactgctggggcaagggaggtctgctgccggtctcttccttcctcctctgactgggtgctccttgtctaggttccttgcagcaaaagaattctctaatttattttgttcccttattgagtctctactccatgaagcccacctcctaatcccagctgactggctcccacctcctcaagaggaaggccaggggcagacgaggctgaaggaggctgactcccctgtgccttcgcagtctgagctgatgctgctgtatgttcacagggctccttcagcttttaaaaaggcttcaacacgttcgtcacacgcttgtggctctcctggatgccacactaactcagtaaggcctgagttagaggctgttcctgaggctgtgaaaatagaagaagggtccagaggagaatcccttcatctgacgatcccaggaaggcttcctagaagaagcagcctctgagctgagacctgaagacagatcaggcctgagtcaggccagggagggtgtgaggggcccaccaggcagagggaacaggatagggcaggcacagaggtctggcacctggcttgtggggaagtgtgagcccctgggcatgaccaaggcggggagaagtggcgtgagaggaggcagatgtggctggcaggagatcggcggccccggccttgctgagctccactctgtatgcaccaggtgacagaggctgcccaggacggtgggcagggaagtgacaggtcacatggtcatcccaccaacagccgggagtccagcttggggggacccaagaccctggggaaggcacgagtcaggggcctgctagagccaggagctagtgggagaaggaaacagtgttgcttatgaattataaacagacactcccgcaactttctctgacgtgatacaatctcaaagtgggccacccagaggtgggaaggtgacttctggctctccaggccttgggcctgtcttttttttttttttttttttttttttgagatggagtctcactctgttgcccaggctggagtgcagtggtgtaatcttggctcactaccacctctgcctcctgcgttcaagcaatcctcctgcctcagcctcctgagtagctgggattacaggcacctgccaccacacccggctaatttttgtatttttagtagagatggtgtttcaccatgttggccaggctggtctcgaattcctgacctcaggtgatccgcccaccttggcctcccaaagtgctgggattacaggcatgagccactgtgcccagccgagcccatcttcaagttctccctggccctcagtgtttctgtattagttcacccttttggctccctgcttttaagagtctcccttaagactgtccccaagtggacaggtccccagaaccaaggagcagccttaggagtccccagttacagacactccagggggtccgtgtggccctcagcctctggcctggttccggcagccttggtcctttgtgctgtctctcacatagcctggccagagctggccaggtcccttggctgggccgagtcatcgtggccagtgactcatgcagggggagaaaagtgaggagggggaacagagtgcgagggggactgtgttaataacaaacccattaggtccctgaggtcacttcacaggagggacaaatggttcatttaggttgatctggctgccggctggcttccagagacactcagggtggggaagatttcattatctggggaaagcaataccagattgtctggaggggcccagccagcgcaccccgcgcttcctgtctgcctcccacgcagagcgttctgttcccaaggcggcaggccaagagcgcgagccgaggctcaggtgcaaagaggggtgcggcatgggggcactgcagggcacggggtgcatgcatttttatttatttttttactgagtgttagggtaatttgttaatggggtatatttggtgacataaaaccttctgtcgattcatggcagtctggaacggagtggaagcgtcccactcctggggaacccccacacacatttggctgtgaacgtcggtgcctttgcactggagcctctttggagtgtgctgggcagagcggagaggttcctcttctctcttctccatcatcctgtggaggtgtcaacatgtagccagagatggtcagtggcagtgaggagaggggggcaggaagagaccagggctgggggcttgccagcccacagttctacccctgaacacccatggcctccctgttcaggtcagcgaggctgggggcagagacgggcaggggtcccccaatgttgggcatctccccgctccctcatactctggatttgccctctggagaaagctctggagcacccagaagtcctggggctgctggctgaggtggggagcagagcccagctgtgcctggaggctccccacttccactcagcttccagggacagtctcagctgtgcaggcccaggccgctgaggctggctccagaaatttcttcacaaccaccactggatggaaaaccagttctctaaagggccccagagccagttttgtttcttcttccacaggttcccatagttagagcatcgggtctttgttagagatgcagaagagacgatgtccccagcccttatgtggttcggtctccactgtggatgttggtgatcttagtctccttctcaaaaccaagagggctgatgccccacattccaggcccccagaaagagccgccacccacccacaccgctacatcttctttccacttttctgttccggaaagagtagagtggatatgcgctcctgtagaaatccatctacagcctgactgcagatgtattttgctcccttattgagtctctgctccatgaagcctgccttgtttgtacctctttctctctctttctctctttcttccctctcttccttcccttccgttcccttcctttttctttccttcctgtcttattctttcctctttctttctttcctctctctctctttccccctttctctgtctttcctatcttttctttctctctctttcctcttttttgaacagccaaagatagaatgaatggcataggtaggtactgagctccctgtaactggaggtgttcaagtgtagggtggatgggcatttatagggcaggcattgaggaaggatctccctgggattgtggatggcaggacaggccctgtggagccttctgagcgggtgcagaagagggagggcatgttcctgctccctgcccttcccgggttgccaggccgccactcccaacctccaccctctttccttccacctgctgggccttacgggatgggcagaggcattgttagaacatggagccgcggtccacagagggccagcagggaggagagctccctggggaccacgtcgcctcagtcactgtggtgactttgaaaataaatgctttcttctctgcttgagtccctgttgttcctgctgacgtggaactagggcaggctggtgactcagccctcatccctgcactgcatcggtggcaagttgcctccagcctcagaccccacagagcagggtgccttcttcagaaaaacagtagggaggccaggacaccaagggccccagggacagcctgtttctcctggctggcatgagttctagccaagcctcctggtaccctgggggtgaggaggtaccagctgtgtgctttagtcactggctgctttgaggctgggtcggtgccaggctggccactccttcttgtcccctagtgtgactttgcagagctcccggaagggtcagagggtttttttccatcactggtgtccatgggatactgtgtccccatctcatttttgtactccagtctcagacgggtgctaggaagttggagactttagccatttcacgactgtgtcttgcggggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttggaggggtcatactttccacccagtccttcagtccttctgtcctgtgtgtgtgcagcccctgaccaccaccatccctgcccctgccacttgctcccagggttccatcaggttggatgttattgcaataaaatgtagcaacagaaggtccaggcagtgctgcagtccctggtggtatcatcagagccagcaggcagcagggctggggaactccaagctgattcagtcccaagtgccggagcggggagctcggatgaggtgggggtggggaaccggggagccatggagcagagcatttgctgtgctgaaggccaggagcctccttgggagatcatgaatttagaacactaatactttgtttaaaaagtcccctgccttggagataagagctcaggccgctgtggtcaggttttgctgtaaatgttctgcacaaagcaggctggggggatcactgggaagtctggggaacagattggtcatgtgcttctttgagtgaaaccttatggttgcattgaagcggccaggcagagggtgtgatggggtgtggtagctgcacaccggctcagtcaggctgaatggggaaatgcaaactcaggtggcctgaaagagacttagtggtccacagcctggtggctgctcccagtacaggtgatgtaaagagagaaggggttccgggggcttggcccaggtggaaaccatgcactgtctgtgatcctgggcatgtcgaggctggagcaggtctgcttggtggctggcagaacgcacatgaagaatccatgtgtgttctgaacgtcccctctgcccctttgggctcatgccccatcaggagtctcccgactctgccattctgcaaaggaaactgcgctttgtcattgcacaggatcgaacaggtgtgtgtggagtccctaaagccactgtctcaaggggtctcatgggacaatgggagagttgctgtgatgtttaagactaaagtgatggctgggcgcagtggctcacgtctgtaatcccagcactttgggaggctgaggaggatggatcacttgaggccaggagttcgagactaccctggccaacacggtgaaaccccatctctactaaaaaaacaaaaattagccgggcatggtagcgggtgcctgtaatcccagctactcgggaggctgaggcaggagaattgctccgatctgggaggcggaggttgcagtgagccgagatcacgccactacactacagcccgggcgacagagtgagactgtctaaaataataataatgctaataataaataaaataataataataaaataataaaagcaaggacttgaacaaatatttgcacacccatgtttgtagcagctttactctcaattgctcaaatgtggaaggaatggatatacaaagtgtgtgtacacacagtggaatatcattcagccttcaaaaggaacggaattctgtcactacatgtgaaccttgaataatgaaccttgaagacctcatgctacgtaagcctgtctcacaaggacaaatattgtatgatttcacttatgtgaagtcaaattcatagagaaattggaatgacggttgccagcagctaggggaaggaaggatggggagttattgtttaatgaggacagagtttcagtttgggaagttggaagaagtttcggaggtggatggtgttgatgggtgtacaatgtgaatgtacttaatgtcactaacatggaaacttggttaaaatggtaaatttgtcttttttgtttttgttttttttttttttgagacggagtctcgctctgtcgcccaggctggagtgcactggcgtgatcttggctcactgtaacctccgcctcccaggttcaggcgattctcgtgcctcagcctcccagagagctgggattataggcgtttgccaccacgcccggctgatttttgtatttttagtagagacagggtttcaccatgttggccaggctggtcttgaactcctgacctcaggtgatccacccaccttggccttccaaagtgctgggattacaggcgtgagccatggtggctggccaaaaatggtaaattttatattacatatattttatcacagtaaaaatgcattgctctattagaaaaatgatagatttttacaatatgaattaaattacaagttatgaaggaaaaattaagcaaaacattaaaaaattacttataagtaattatatttaaaacaaaagataataaatacacaactttcatcacctcttaggttttttgcaacatttaactattgtctgtcctgttgcggttatgttcttgaggttgtatttgtatgatagaaacactatattcgtggtgactaaacatctcttctcagtctcacctccaatgatgtcatacagataacttgaaattggccggctgggcacgatggctcatgcctgtaatcccagcactttgggaggccaaggcaggcagatcatctgagttcaaaaccagcctggccagcagggtgaatcctcatctctagtaaaaatacaaaaattagccaggagtggtggcgggtgcctgtaatccgagctacttgggaggctgaggcaggagaatcacttgaacctgggaggtggagtttgcagtgagccaggattgccccactgcactccagaccgggtgacagagtgagaccctgtcaaaaaagaaaagaaaagaaagaaattggccaaggcaggaatattgacaccacaggaataggcaagcgctacaaatcgggaaactgagtgttgttgcttttgctggccccaggtggccggttgttgaccgttaactggcacactactggaggagggaggttcagactgattcgcagagagactagaggtagaaacgcaccatggtttggatgctgagggtgagggaaagagaggagtcaacagtggtgcccggagacttggcttgagcaactaggtggatggtagcaccgtttcctaagatgaggggctgtgggaacttgaggggctgtggaaggctctgccactgacggacccagggctcggcagctctgggaggcctactttgtgtcaggccacgcagagataagaccatctgggccctgcccttgggaagtctctgtctatgaggacacagcctgccacctaatggggtgtcccgtctggagcctcagtgttgctgggagaaagcccctcaccttccttcgctctccgagcctcttttgcttccctgccagctgagcctctccatggaggctgtgcctggaggggggtcatggatatggatgtgtgcgccaaacgctgcttcctcgtggatttcctccccactccgttcccacgctttgtaagcttcatttccccggggcctgacctgtggggtttctctccagacctgctccttcccatttccagaaaggcgtgcaggggtttcctatggctctcttccctgtccccatcccccttcccttgggacagtgatctgctggacgggtgggctacccacagggtttgtgattgcttagacatctttgctgtatgaagctttgacctcaaggcatgatgcagatgggaataaggcacgagtttctcctggctgctgtaacaactgtcgaaactgggtggcttatagcaaggggaatgtgtcctctcacagttctggaggccagaagtctgaaatcaaggtgccagcagggccagcttcctctgaagactccaggggaaaacctttctttgcctcttccagcttctggtggccccaggtgttccttggcctgtggctgcatcactccggtctctgcctctgtcttcacaaggcctttttctgtgtctctgtactttcttttctgtctcttagaaggacacagcattgaatttagggcccaccttatcttgagatccttgcctaaattctttctgcagagacccttaaacagaatcaggtcacatttgaggttccaagtgggcatatctttgttttgggggggatcaccggcccactgtaggtctcgttgtgcactgaagacgcaggcggtccctttggccaggcctgcagtcggtcttgccttcttttgtgaccgtggaagaatgcaccttgctggatgcacaggcctttatagttcttttgttcttgccaaatttcagctcagtttcctctctgctgccggcgtgcatcttctctgcccagtgccccttctgggactgtgtgtccaggccctgaggccctagaaaaggggggtggagggcctcctcactatcctgtagcaatgaggcctcattaaaatcctggagccccagactggacccagcccttagctatgatcaaaggacagctcgggatatgattaaagggctagagaaagatgatttaggctgagaaagaggaggccaaggagcaactggattgtccttgaatgtggaaaaggtaattatgacttgaagggtggtgcccagctgtttcccatctcctctgaggacaggaaaaaaaaggaaataaatgatgtacaattagagcagttggttagatacgagggtgaacttcctggctgggagtatggccaagccctgatttgggtttcctgaaagagctcggggaacctccttacctggaggtttctaggcctggtcatgtggctctgagtgattacattgaaggggcagtggctggggctggagccggtgggctctgagcacagtcacgaaggcatgcgcactttctggctgctctcctgccattgtcccttgggttcccattttggtgaggcgtgcaccctggcggcgctccccagggaactaaatatgtttgctgcactgtgcgtggagatggagaatgtacaattggctgaccctgtgctaatctggtggaactccatgccagccctgggaaagaacaattgcatgggtgtgtccacactcaccaggtgctttttagaaaaacactcgagaataatgctgtggcttaggatggctgttgtgccggacccggcatcttcccaggggggctgtgttgttgggctgagtttcttaggtactggacccccaaatccccaaatacggcgtggacaggtggcccagtaggggctggactatccgataggcccaggtgctggagttcagacaagacataccctggcctggcgtggaagatacggggtgctattaatggcagcaatggctgcatttctgaaacccgggctcccaggccgacgagggtgtgcacgcatctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcactcctgcacatttgggatatttcagagggggtggggaggggcaagtgggcagcgagcgacctcagacccaggatgagctgtcaggcgctccccggccacacattcaagggaccggagtgcagttgtagcgttgcggcctgctgcttcgggggtgggggtgttgttccatgctgtgaattctcacatggcccctgactctgggcagaggccgagggtctaagggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcctccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgtcctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 2 - DNA, 1405 bp, Homo Sapiens
cgttacccgagttgtaaagggcggctccctgtgtctgccccgctgcaccgatacaccgagctgcgcacggtgcccagcgcagggagaacaaatgatcatctgtccaacgcgcccatttacaggtgaggaaactaaggctccaactcaatcgacgcactctgcccttttgattaccagaaaagtagcaggacaggtgtcctgtcccgccctaccccggcccactaagccggcaccccggctccgacccccggctgtgcccggcgccgccgcggtgcccggcgccgccgcctcgcccggcggggccgcccggagcgcccgcacctccgcccgcttccacctggccgggcccgccccgcccggactcgggactgggaagtgcggcgactcccggaaccagccattggcgccagcgcggggagctgggggtgcagagctgcgggcgcggcgggccacgcaggcggcccccacccccggcctggcctggtctggtctggtctgcgctgccgcgcgggggcgccccctcccaggcccggcgcccgccagccccgctccgccaggtgcagcgcagcgcaggggtgggcgggggtggggctcggcgcgcacgttcacggggcggggagggggcgggtcaggggcgggaccacagccggctgggccggggttctatgcgcatctccggggaggggcggggcgggggcggggccggggcggggcccggtcggtgcactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgc

SEQ ID NO: 3 - DNA, 2365 bp, Homo Sapiens
gtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgc

SEQ ID NO: 4 - DNA, 219909 bp, Artificial Sequence
  chemically treated genomic DNA (Homo sapiens)
cgttattcgagttgtaaagggcggttttttgtgtttgtttcgttgtatcgatatatcgagttgcgtacggtgtttagcgtagggagaataaatgattatttgtttaacgcgtttatttataggtgaggaaattaaggttttaatttaatcgacgtattttgtttttttgattattagaaaagtagtaggataggtgttttgtttcgttttatttcggtttattaagtcggtatttcggtttcgattttcggttgtgttcggcgtcgtcgcggtgttcggcgtcgtcgtttcgttcggcggggtcgttcggagcgttcgtattttcgttcgtttttatttggtcgggttcgtttcgttcggattcgggattgggaagtgcggcgattttcggaattagttattggcgttagcgcggggagttgggggtgtagagttgcgggcgcggcgggttacgtaggcggtttttattttcggtttggtttggtttggtttggtttgcgttgtcgcgcgggggcgtttttttttaggttcggcgttcgttagtttcgtttcgttaggtgtagcgtagcgtaggggtgggcgggggtggggttcggcgcgtacgtttacggggcggggagggggcgggttaggggcgggattatagtcggttgggtcggggttttatgcgtattttcggggaggggcggggcgggggcggggtcggggcggggttcggtcggtgtattttagacggcgggtcgtttttttttttcgtttttttattatcggtttaggattagcgttttgggagcgcgcgtttcgttgtttcgtcgttatatttttttgggagcggcggttacggaggtattatgaagaagttttatttaggtgggtttcgcgttcggggtggggaggggtcggtgtttcgggattagcgttgtttatttgagtgtttgcggtcgggagtggcgaggcgttttcggagttgagcgagttttcgcggcgggtatattgtaggtcgagttttttttaggatagggtcgttgtcgggtcgttttcgatttgagtcgatcgttttttgcgttgtttttagtttttgttcgagtgtcggaggggttgttttgggggacgttttttttttttcgttttttgtattttcgtaggaatcgttgattttttaggtcggtcgggtgttttgggtttttgtgcgtttgtgtgggtgaatggggtcggggttaggtggaggggtgtttttgggtttagtttttagggttggtggtttaggtcgtagtatttttttttcggatttttttcggttttttttttatttagtggggtacgggacggtttttagatgggatcgtttagtagcgtttaaatttggcgattcgggtttacgttttgcgtttaggacgtcgttcgcggttgatatttttattttattttagtagggttcgttttaagtaggcgaagggggtttgatttgggttttattatgagtcggtttaggagtttttattttataagaggttttcgttttggtattttgaagttttattttatagatgggtatatcgaggttataagggtaggttaagagaaatttagatttttattatttgtttttttttttttttttttttttttttgtggttttttttaaaggatttaggtaggtaggattttttgttttttttagtttttaaattataaatagcgtttttttttttaaatttagaaatcgtttgtttaatgttttttttttaatttatttagatagaaaggtatttgttaaggatttatgaattaatttttattgataggagaatagaattatgggttttagttggaggtgaaggagttatcggggttatttttttgtttttgggttattgtcggttttttttggttttttatatttaggaattaaaatgagtgataaagtattttgttttaaagaggattatttagaattttttcgaaaatatttttttgggttagtagtttagaattttaatttttattcggttgttgcgaataagatggttttttacgtattcggagtatagttttgttaggagcgtgggtgggttggtgtgttggtgggcgggagcgggtttttaggtggtatatgtttggttttggtatcggggttttttttttaatatgttttaaatatttgagattgttgtggggatcgcgcggtgtatggttttttttaggggatttttagttcgtttagggagggttttttgtttttggttttttatattttattttttattggtgggtttagatagtgggggtgatcggggtttttttaggtcgtgggttttgggttttttttgcggagatttttttgtatagatgtcggaagggttttgaggtaggtttggagtttttgtatttgcggtttattgggaggtggggagattattatttgtttttttttttttttttttatatatatttattttattttttattgggttttttttttttttttttttttaaaaaaaaggatagaattttttgtagtaggtggaagtagagtttgtggagtgagtaggaattaatttttgtatagtagtttcggtgtttttttgtgtttatttaaaggggtaggtttttttgaggatgggggaagggagggtttagattatttttggtttgttttttgtttggtagtggtttaaggtgtgttgggttattgtgttgtagttgtatggagtgggattggagggggttgatggtgggggtggttttttgtttttattttgagtgttttggagttgttttggtattagttttttttcgggtacgggtattcgtaggagttaggttgattttttaataagttatcgatattatgaaattaaggaaagtagtaaaagatgttaaaaattttttaaggttttgataatttaaggataataggaaggtttttatttttttatttagattgtgcgggattattgtttttagatttgtatgtgggttttagaataaacggaatgattataatgttgttttcggtagatttggtttgaatattcgtgagtttttgaaaaggagaaagattttagaaggatgtgttggggtaattttaagtatcgtgggtttatagatagttatcgaagatattttatgtgttgggtatatatggttaagtttgagtgggtatagaaatggtaatgagatatagtttttgtttgtagagaatttatatttttatcgggagttaggatgagggcgagatattagtttattaatattttttttttttgagtagtttagtttttaaatattataggaatgtttcggaggttttaggtggaggtgagattgagttgggttttgaggaaggagaagttttgagtagtggagaataaaaagggatttggttaggtgcgtttgaagttttagttatttaggaggttgagatacgaggatcgtttgagtttaggaggttatttaggaggttgagatacgaggatcgtttgagtttaggaggttatttaggaggttgagataggaggatcgtttgaagttaggagtttaaggttgtagttttgtgatagcgtttggaaatagatacggtattttagtttgggtggcgttatgagattttatttgtaagaaggttttttttaatgcggaaggtagtaagggtttatatagggtagttgtaggatttagggggatattggggataggttttttttggtagttttattgttgttttaggttttttcgattgttttattcggttttttaatggggtggaggtagtggtagtttataggtagtgtggtttagtggttatatttgggggtttagagtcgttagttttttgggattaaattttattaggttgcgtttttttttgtggtataaggtttttattttatgtattttatttgttttatttgtttttttgtgtgtgtggtgttttttaattttatttatttatttatttttgagacggagttttattttgttttttaggttggagtgtaatggtatgattttagtttattgtaattttcgttttttaggtttaagtgatttttttgttttagttttttgagtggttgggattgtaggaacgtgttattgcgtttagttaatttttatatttttattagagatggggttttattatgttggttaggttgatttcgaatttttgatttcgtgatttgtttgttttggttttttaaagtgttgtgattataggtatgagttattacgtttagtttgttttatttgttaaatgggatagtgttatgttgttgtaaaggttaaacgagtttatatttgaaaaagttgagaaatgtttgttttgtaatttgttagttgttgttatgattatgattgttattgataggaggatggagaaggttggggttacgttattgttaggacgttttagaagtttttatgatttttttttattgtggttagagtatggtgtagggttttttttttagttttttagtattggagttagttgtattgtattcgttttggttttttaggttttgagttttgggattttttttgtatattaggttatatggaatttgtcgttatttttaggtttttttggaaattttttgtgggtggtagcggtaggaggatttattcgaggtcgatgagttatagaagcgggattgaggttgcgttatatttttattggtatttgggaattattttggagattttttttttattttttatttttttgagatggagttttgttttgttgtttaggttggagtgtagtggtacgatttcggtttattgtaatttttgttttttaggtttaagtaatttttatgttttagttttttgagtagttgggattataggtatgtgttatcgtgtttagttaatttttgtattttttagtagagatggggttttattatattggttaggttggtttcgaatttcggattttaggtgatttattcgttttagttttttaaagtgttgggattataggtatgagttatcgtgtttagttattttggagtttttttgtggtttttaggagatttttgaaggggtattagttacgattaaaaagttttatgttgtcgtgatttttgagttttgggtagggagggaggttgtatttatataggaagtagtttttgtcgtgatttagtgtgttggttcgtcgtggtggatagggttgtatttttatttagcgtttcgggagttgatttacgggaagggtaaggaattgtatttttagagaatatttttttagttagttaattcggtgataggcgagcgtgggaagggtataagtatagggtttttttttttttttttttagtttcgttttcgcgtttgttttcgttgttttttgtttttttacgtttaagtttgtttgttttggcgtatttaggggatttggattggagagaaaaagttatttcgtacggttagtttgtggttttgtttgatttgtgtttttcgtcgaggttttttagttgtgagatagttggttgagtttaagttttggggttagttttttttttagtttgttgtaaaggtagaaaggtatgtttaggtaggggttatttgttttgttcgtttacgttagatcgtaggtatttgttcgttagattttttcggtttgtttagagggattttgatagtcgagggtaatgtatttggtagcggagtattgcgtttgcgatagtttattttttttttggaattattttttataagtgtgattagtttaagttaggataggtatagggggatttaggattgttatttaggggtagtggtttggaatttaggtttaggtgatatgggagttaattttttgtttggagattttaggtgggtgtttgtagaggatattttatttgaggatttatggaaggggatattttttattttttatttggtttttgggttgtttttttttgatatttttttgttattttaggtagttttgatagttttatgtgattgggatttagaggtggtttttgttttcgttttagtgtttgtttataggtagtgttgcgtgggttttgaagtttgtttaagatggatttgataaggggagtttagtatatattagtgtaggttcggttagggggtgatgatggtagtttttgggtagatttagttggttttagggtaggaggggttttagagagaggttttaggtttttaggggtgtgaatttttggggtgaggcgggaagtgacgcgttgggtttttgcgtttttgtttgttggagttattattttggaaatattttagttttaggcggttgttagggatttatggggattagtgggtgttaatttttgggtgaagttttcggggtttgtatatagtatatagcgttgtggttttatggtttattttgttgtgtgaagtggtttagttttcgggagagtttttagttaggtaggtttgacggtaattgttaggttatggtgatttggaatcgttgattaaagggagttagttttggtgggtggagggatttggtgggtagttatcgtgatgttaggtatggggatcgtgtgttatttaggtttgtgggtgtcgagtttttgtgggagtagtgaagtgttttcgtggtcgatgggttggttatttttgttttttttttgatgtgatagttgtgtttgggtttcgggaaatttgttaggaggtttggtattggtttgttttattggagcggttttgttgagttgtgagttgttcgtttttttgaggtttttagtttattttaattttttatgtggatttggttatttattttagaagcgtttgtcgggcgttgttgagtgttaggttttgtttgtttttttttttgtacgttggaggttttgggtattagttttgtagggtggtttggttttgggtttttagggtagagtatggtattttttgtttttagtttagtttttttttgttttatttttttgattttattttgggtatgggtttatttgtagtttttgtgaagggagatattgagttgttgttggtagaggaggggcggtttttgggtattgtttgttaatggtttttcggtagttttgtgatagttgagttttgtttttagtttaatttgatttggttttttaaagtatgattgttggtagtttgaaaatttttaggataggaaataggagtggcgtagggaatgtaagatgattttagttttaagttattgggcggtttttagatttaggttgtttgttgtttttggtaggaatttaagtcgttggttatttttagagcggtgttggttcggggtttttagtggtttttgtgtttgggtgagaggaattttggatggttattttgttttgagtgtgtgggtttttagaagtgttgggttagggggtacggagggttagaaagttttttttggagcgttggattttttcgttgatttttattttatttcggtttggggttttagagaaggggtttaggtaggagtgttatttttttttaatggggatgtggttttagtttttgtttaggtgggtgtattgtttttttttcggttttttttaggttgtttaaatgatttgtgacgaggtttgcgttatggtcggggttttttgttttttttagcgttgtatttgggaattaggggttgggtttcggaagtcgaggatgtttttgaatgttatgtttgggtatttgttttggttaggcgaggcgtgttggggtagcggttgagatgggagtagtagtattgtttgttaggtttgagatgggtttcgggtgagtgtggttattaggaagggttgggtagagtaggcgggtgggtcgtttttggggttttgtttcgtagattaatttgattcgtattttggggtcggggtttttttttatagtttttttatgaattatggtttttgtttttattttaaattagattttagaagaggaataatgtttatgtaatttaagttagttggaagtgggttatatttaatttttgttattttttagtttgttaaggatttgattaatttaatttagagggatttggagggttgtttgtaaaatttattaataatagggaattttagttttgtagttatagggtttatagaggtgtcgggttgtcgggttattgttgggaggtgagtcggtggcgtagatattatggaggtatcggtagtggaagagttgtaagtgtatatagaggtcggtatcgaggggcggggaggaggaggtggtggatttttcgttagtgttggtattatgttgtttttagtattagagatttaaggtgtggttgattttggttggggcgatgagttattggatagtagagtttttttggtagttgggggttaacgttttaattgtcgggattttgtattatgtcgttttttttttttgttttgtttggtttggtttggtttggtttttgagacggagttttattttgttatttaggttggagtgtggtggtttaattttggtttattgtaatttttgttttttgggtttaagtaatttttttgttttagttttttgaatagttgggattataggtacgcgttattatgtttggttaatttttgtatttttagtagagatggggtttcgttatgttggtcgggttggttttaaatttttgattttaggtgatttatttgtttcggttttttaaagtgttgggattataggtatgagttatcgcgtttagtttgtatttatgtttttttttttttttttttgagatggagtttcgtttttgttgtttaggttggagtgtaaaggcgcgattttagtttattgtaatttttatttttcgggtttaagcgatttttttgttttagttttttaagtagttgggattataggtttgcgttattatgttcggttaattttgtatttttagtatagacggggtgtttttatgttggttaggttggtttcgaattttcgattttaggtgattcgttcgttttggttttttaaagtgttgggattataggcgtgagttatcgtattcggtttatgttttttattattattatttaattttttaaggaaagtaatttaaattgtatattgtatttttttttttttttttgttttttgttgttagttttttgtattatttattgttaaataatatgaataggaaattgaaaggaaaattttaataattattggttgtagtattttttttgtgttttatttagtgtttgtttttttaggaatatgatatagggtttgatttaattatgaaaggcgtatatttttagagttttatattttttatagaatgaatgttgaattttgttttttttatttgaaattagattttaggtatggattttatgattattattataatggttttttagagtggatattgtattttgtagggaattattttttttttagttgttggtgtggacgtttttttttgatggtgtgggtttgggtttttgaagggtggtgttttgagtaaagatgttatagtagttatgtttatagttttgggtttggggttaggtggagattggttttaattttagagtttgttgttttaaaataaatttttttttttttttttttgagatggagtttcgttttgttgtttaggttggagtgtagtggcgcgattttcgtttattgtaagtttcgtttttcgggtttatattatttttttgttttagtatttcgtatagttgggattataggtattcgtttttacgttcggttaattttttgtatttttttagtagaggcggggttttattatgttagttaggatggttttaattttttgatttcgtgatttattcgttttagtttttaaagtgttgggataaaataaatttttagggtcgggagcggtggtttatatttgtaattttagtattttgagaggtcgaggcgggtagattataaggttagaagatcgagattatggtgaaatttcgtttttattaaaaatataaaaaattagttgggtgtagtggcgggcgtttgtagttttagttattcgggaggttgaggtaggagaatggtatgaattcggaaggcggagtttgtagtgagtcgagattgcgttagtgtattttagtttgggcgatagagtgagattttgttttataaataaataaataaataaataaataaataaatttttatatttatttgtattatttattattattattattaaatagggttttgttgtgttgtttaggttggagtgtagtggcgtgattatgattttttagtttcgattttttagttttaattggttttttttttttagttttttgagtagttgggattataggtgtgcgttgtatgtttggttaattttttttttttttttttttttgagatagagttttattttgttgtttaggttggagtgtcgtggtgtaatttcggtttattgtaattttcggtttttggattaaagtaatttttttgttttagttttttgaatagttgcgattataggtatgtgtcgttatatttggttaatttttgtatttttagtagggacggggttttattatgttggttaggttggttttaaatttttgatttcgtgatttatttgttttggttttttaaagtgttgggattataggtgggagttatcgcgtttggtatgtttggttaatttttaaaaaatttttgtagtagtcgggcgcggtggtttatgtttgtaattttagtattttgggaggttaaggaggtcgggagttcgagattagtttgattaatatggagaaattttgtttttattaaaattataaaattagttgggtatggtggtatatgtttgtaattttagttatttaggaggttgaggtaggagaattgtttgaatttaggaggcgggggttgtagtgagttgagatcgtgttacggtattttagtttgggtaaagagagtgaaatttcgttttaaaaaatttttgtttttgtttttgtagcgatagggttttgttttgttgttgtttaggttggtattgaatttttagttttaagcgatttttttgttttagttttttaaagcgttgggagtataggcgtgagttattgtgtttggtttttatttgttttggttgtttttttttgttttaggtaattatatatttttttaggtaattaagaaaagattgcgtatgatgagttttttttttggtatttttgggattgtttttaaaattagataagtgtttttattttgatattttattaagattttaatgaatagaatgtcgtttgtttttagtttgttggtttttttgcgaaggtttagggtttttttgtttgaaaagttatttttttgtcgaggtttttgatttttttttattacggtagttatgtcgagggtttatagagttattttttttttatttttttttcggttttttaagacgtatttgtattttcggagatgtttttttgtttttttgggttattttttttggtcgttatttattttgttgatttattatttgtgtaatagttttttttggaatttttaggtttttgttatttattttttgtagttttcgttttgttttttttgttttagtttttttttttattatttttttatttgttggtttttatttttgtttatggtatatttttgtgttatattttgatggttggataaaggttgagtgaaacgtatttatttttttggtgattggggtgtttattaattagaagggatttaaggttggcgtagttttttttcgtattttggggtatcgttttgtggtttttttttgttggagtttgtagttttttgtttttttttttttaaattttttgagatggagtttcgttttgtcgtttaggttggagtgtagtggtgagattttagtttattgtaattttcgtttttcgggtttaattaatttttttgttttagttttttaagtagttgggattataggcgttcgttattatgtttggttaattttggtatttttagtagagacggggtttttttatattggtcgggttggtttcgaatttttgattttaggtgataggttcgcgtcggttttttaaagtgttgagattacgggtatgagttattaggttcggtcgttgagattatttttataagttattaggtttggttgtagttggtagtttttgattattggtttcgttttacgtgatttgtgattttttttttggttttttggttttgttttgtttatttgtttattttttttatgtatgcggtttgtttatagggtatgtaatggggtttaattaggaaatggaaatcgtttgagtatttatttatttatttatttatttatttatttatttattttttttaagataaggttttattttgttacgtaagttgaagtgtagtggtgtgattatagtttatggtagttttgaatttttgagtttaagcgattttttttttttagttttttaagtagttcggattataggtgtatattatatgtttgtttaatttttttttttatttttgtagagatagggttttgttttgttgtttaggttggttttgaatttttaattttaagtaatttttttgttttagttttttaaagtattggagttataggtatgtgttattacgttttgttaatttttgtattttttgtgtgtgtgtaaagataaggttttattatgttgtttaggttggttttgtatttttgggtttatgtgatttttttgtttgggttttttaaagtgttgggattataggcgggagttatagtgtttggtttatttgagtatttagaatagaaggatttaaaggcggggaattagttatatagatgatgggagaggtgaaggttagatagggaatagagaggtaattagtaggaaattaaagtggtgtgggtttatatagttttttaaaggtatggatgtaatgatttatttagaatgagaaaataaataatagtaaattataaattataagtagttgttaaatattataaatattattatatgtagaagagtattagttaattgttagttatatttttaaagttttattttttttatatttttggtattatttttttaatatgatgattttgtaatatcgttttttatttcgagaatagaaaattgattaggttggatatagtggttcgtgtttgtaattttagtattttgggaggttaaggtaggtggattatttgaggttaggagtttaagatcggttcgggtagcgtggcgaaatttcgtttttattaaaaatataaaaattagtagggtatggtggtatatatttgtagttttagttatttaggaggttgaggtgggaggattgtttgagtttaggaggtcgaggttgtagtgagtcgtgattatgttattgtattttagtttgggtgagagagtgagattatgttttaaaaaaaaaaaaaaaataataaaaaaaaatataggttgggcgtggtggtttacgtttgtaattttagtattgtgggaggttgagatgggcggattatttgaggttaggagtttgaaattagtttggttaatatggtgaaattttatttttattaaaaatataaaaaattagttaggtgtgatgacgtacgtttgtaattttagttatttgggaggttgaggtaggagaatggtttgaatttaggaggtagaggttgtagtgggttaagatcgtgttattgtattttagtttgggtaatagagtgagattttattttaaaaataaataaataaataaagcgaatgaatttttttagttgattaaattttgtttttatttttggtagttgggatgtatataaaagtggcggttaatatggagttggtggtgttgttataattgttttgtttaagatatataggaattttggtaaattttgtttttttttttttttttaaatgtgatttttattaagaaagaagtaggaaaatgggggagatttttaattgtatatgaggtatttgtgtatgtatttttgattagagagatttttttgttttgattttatattgaaggaattgaattttttgtttataattttatttttggtgatgggagtaattttttatagatttgtttttggattcgtgtattttaaattttgtttttttttattgcgtacgttttttcggcgttaggtatcgtaggatatgttcgtgttttgtgatttttgattttgcgcggtaggtggaattggaacggtgagtggagcgagtattgttggaattcgtttttatatcgggatagcgagtagtaattgaattatatatggaaataaatgggaattatataaatataattcgattaaagttaaattaaatatttttttagtttaatttttttttagtaggagtttttacgtggtagtaagttttcgtttttattttatataagagaaaatgtgacgggtaggaatttaagattggaaatgaacggggacgttaattgattgtagggaaaatattttttattttgtaaattttataaaaaatgtttgattttgtggatatgtggttagggttttttttagtgttttgagagggaattatgtaggtagagggagggtttttagtattgtgggggtgatttggagattggtagtagggtgttattattatttttaggtggggatgagagggaggaagttttgtgattagagtttaggggttagagttatttgttgggagtttaaataaaggtgggattttggtaggagttggaattatatagaggattattttttttgttggagaagttgtttgaggtagaggaggtggagagttttcgcgtttttttttgtttttattttttaggttttttttaagtttttcgttggttgaatttagtttaaagttagtaggtttggggatttggatatttgagttagtagaggtcggcgttttttttatataaaggagggtataagaagtgggaggtacggagggggattaggttaggatttatataggatgtgtaaataggagtttttttttttttttattttaaatggtatttgtagtcggttttatttttttgttgttagataggaagaggaattttgttttcggtattagttgtttttatcgttttttattttacggaggttttttttttttttggtttttgtttgtaattattggcgacgttgatggattatattttttggggagtttggttatgaatatggttttttatttgttgtggattaaattgtgtttttttttttgaatttttgcgttgaagttttaatttttaatgtagttgtaattgaagatagggtttttagggaggtaattaaggttaaatgaagttatagggtaggattttaatttaataggattgatgtttttataagaagagggagagatattagagattttttttttttttttatttgtaaatagaggaaaaatgacggaggatatagtagggaggtgggtataagttaggaagaggggtttcgtcgggaattaattttgacggtattttgattcgggattttgggttttttaaattgagaaatatatgtttgttgtttaagttattttttttatagtaatttggatggtagtttgagtttattaaggtatcgtttgtattagttagggttttttagggagatagttaataggagatggatggatggatggatggttagatagatagataagcggatagagagagagagagataggtagatatagatagataggtagataaatggttagatagataagtagatagagagatagagatagatagatataaataggtaaatagataggtagataaatggatagatagatgatagatagttaggtaggtagatagatatagataggtagatagatagatagatagatgataggttgggtttagtgatttttatttgtaataattagtatattggtaggttgaggtcggtggattatttgaggttaggagtttgagattagtttggttaatagggtgaaattttatttttattaaaaatagaaaaattagttgggcgtggtggtgtatgtttgtaattttagttattcgggaggttgaggtacgagaattatttgaatttgggaggtggaggttgtagtgagttgagattacgttattgtattttagtttaggcgataaagtgagattttattttaaaaagaaaaaaaagatagatagatgaatggatagatagttagatagatgatagatggatgataggtagatagataattgataaatagatataaatgatcgatggataggtagatatagatatattgattaggtagatgatagatggatagatagaagatagatggtggatgggtgggtagataggtagatagatagttagaaagatagatgatagatagataggaaggaatttattaggggaattggtttatattattgtggaggttaagatgtattatagaaggtcgttcgtaagttggaggtttaggaaagttagtatcgtggtttagtttaagtttgtaggttttaggattgggaagttgttgatgtaatttttagtttaaggttaaaggtttgagagtttggggaattgttggagaattgggagttttaagtttaagggtaggagaggaaggtattttatttttaggagaaagagggaatttattttttttttgtttttttgttgtttggtaatggaatggtgttatttatattgagggaggatttttattatttagtttattaatttatatgtttattttttttagaaatatttttatagatatatttagaagcgatgcgttattagttattttttaatttagttaaattgatatttgtcgttagttattatataggtttagaagaatcgtggttgtatggtgatggtttttatttcgtttaaagaagttgaagatgaattgttggtataagttatcgtttttttaggttttttttagtcgtttatttttttaaaaatgtatttattgagtatttgttgtatgttaggtgttgtgataagtattggggtatagtagtgagtaaataaggatttttgttttttggagtttatatgtagtagaaggaaatagaattaatgaatttattagttttagaaattattaaaataggattaagagttgtggtgagaattaagataaggtgattgtatagaaagtgattgatggttgttttggaatgagtggtgaggggttatagagatgatgatagttgagttgagattgggaagataggaaggagttagtagtgtaaggattaggttggaagtaagtttggtgtattttaggaatagtaaggaggttagaggggttgtagtagagtaggcgaggaggaggagggagacgtaggttaaagaggagtttggggttagatggaggattttttttttaaagtttagttattttttttttaaaggagaatgtgttatttttaaaagttatatatgttagtatagtgtttggtttattatatgtttttagtaggcggtgagtatggttgtttttgttattattatattataattattaggaataatggagttattaggttttgtatttatagtaatgtgagggagttagtaagtttttttggggaatttatttttttttattaagtttataagagtttgataattaggttaatgtagtgagagttatagttgtttagtgtattggattttttagttacgggttaggatatttttattttagtagaaatttttaaggggattggggagtgtgttgtggatgtttttgggttatttagattttttggggagttttttttatcgtagttgttgtagggagtttagttgtagtgatgaattgcggtttagttttgtttatgggaaaattttatatgggagatgggacggttttttgttggttttttcggttttaggttgtttttataagtgtagggatttttatttgggtgtgtgaatggggtttaggatgttttaagggtatgtggagatgggggttagttgttttttttgatgtttttgaattttttttttttgtttttttgtattttattgttttttggttttttttattttgggtgttttggaataatatgtaatttaatatataggttgattttattattttgttttgttttattttattttattttggaaataaaggttttgttatttagtttggagtgtagcggtgtaattgtaatttattgtagttttgaatttttgggtttaagtgattttttcgttttagttttttaaagtgttgggattataggtatgagttgttgtgtttggtttaggttggttttaaaagttttttattttttttgtattttgatgatatttattttttggagtaggtttttagttattggtttcggatattttgtagttattattggttagttgtggtatgtgaagttgaggtttaggagaagggtagttttgtttaaggttatacggtttagtgttaatatttagattttagtgtttttattttttttttggtcgtttttatttttagtgtatttttggaggtttaagggagttaaaggttaggttttggttagttaagaatttaaaaaagttgtttttgtgtttttttgttaatttattattttattatttttttcgataatgaatttagtttgaattttagataaataaggattaatttttagtataagtatattttataatagatttgggatatatttatgtttaaaaatgatttattgtttgttggttttagtagtttatgtttataattttagtgttttgggaggttatagttggagaattgtttgagtttaggagtttaaggttatagtgagttatgattatgttattgagttttagtttgggtgaagtagtaagatttttatttttttaaaaaattgttgattgtttatttgaaatttaggtttaattgagtattttgtattttatatgagaattttatataggtgagatttagagttttaatgtttattggtaagtttttgtagggaggttttgtgggtttttggttggtattgatgttttgtgatgagtagggttatttggtaaggtggacgtttgttgtttatgtaggtagagtaaggttttgggtaggtatgagttgattttattttttttagtttgggagttagatattgttggtagtttgtcgttaagagaggggttggttattaagagaggggcggtttttatgggttttttttggtttttggtttttttttagttttttttttattttaaatagaggttaacggtatcgtattagaattagtgtgttgttttttttggttggtattttgtagttgggtagattgttttttttttataggagttggtggtgtttttttcgttttatagggaggatggttgagatttttgattttgatatagggtgttgttttttttttgttttgagatagagttttggtttttttatttaggttggagtgtagtggtatgatgttggtttattgtagtttttattttttgggttttagtaatttttttgttttagttttttgagtagttgagattataggcgtgtattattattgagaataatgttttttatagtgtttatttttttgtaggagtaagtttttaaggtaaggaggttgttttttttatggatgaataaattgattttgatttatagttttacgtgttagttttgagggtggggaaaggttgttttgtgtttaggtagggggtgggggtaaggttaggagggtttggtgtttagtgtatttttttaggatataattttaggtagtagaggttaaggatagaggggaggagaagagggaggtggttattatttttttattttagttttttttggagataagtttgagtattttagttgtttattaagtttggagataagtttggaatttaaatttttgattttgatttagttttttatagtttttgtgagtaaattgagttttagaaaaagggagtgaagtttgtgtattttggacgtttttattttaggtttaaatcgtttttattttaggtttaaatcgtttttattttagtttaaatcgtttttattttaggtttaaagcgtttttattttagtttaaagcgtttttattttaggtttaaagtgtttttattttaggtttaaagcgtttttattttaggtttaaatcgtttttattttagtttaaatcgtttttattttagtttaaattatttttaatataggtttaaattatttttaatttaggtttaaagtatttttattttaggtttaaagtatttttattttaggtttaaagtgttcgtaatttaggtttaaagcgtttttattttagtttaaatcgttttattttaggtttaaatcgtttttattttaggtttaaattatttttattttaggtttaaatcgtttttattttaggtttaaagtgggaaggagttatagggaaataaacgggggaggtacggatgattaggatgagggtttttatgatttatttttttttaggggttattttaagagttttttaaatttttattattttttaatagagatggggttttgttgtgttgtttaggttgatttttaatttttagttttaagttatttttttattttagttttttaaattgttgaggttataggtgtgagttattgtatttggttttttttaggagttttaagaaaaaaaatgggaatagatttgtgtgtgtgtgtgtgtgtgtgtgtgtgtgtgtgtgtgtgtgtgttttgagaaagagtttcgttttgttatttaggttggagtgtaatggtacgatttcggtttattgtaattttcgtttttcgggtttaagtgttttttttgttttagttttttgagtagttgggattataaatatgtaggttgattttgtatttttattagagacggggttttattatgttggttaggttgatttcgaatttcggattttagatgatttgtttgttttggttttttaaagtgttgggattataggtttgagttatcgtgttcggttaggaatagatttttttttgtagatgatttttgttattattgaaaatggatgtttatgtataattgaattgttataacgttttattttaaaaagtttttttttgagaaaatgtgatttttgatagaggagagattgtttaggttttatttattgttagtataaaggtagagtaggggtgtggcggtgttatttttttttgagatagttttatttttgttttgtttaggggtttagaagtttggtttattcgagtttatagaggggtttggagtggttgttttatattataggtggggtttgtaaggatttgaaatgatttttgagaaggcgggtgtggtgggtgtattttaattattaaagtaataataatgatatattaaatagtgtttgtttagattttgagtgtttgtttaaatatttttattttgtgatttgttagattttagtataataatttaggtaaaagaaaaaatagttgggcgtggtggtttgtgtttgtaattttagcgtgaggttaaggtaggaggattgtttgagattaggagtttgagattagtttgggttatttgagattttatttttgaaaataaataaattaataaaagatttttatgttttatgttttttttatatttaggttttttaaattatatgtattggggaaagtttattaagagaagtttttggtcgggcgtggtggtttacgtttgtaattttagtattttgggaggttaaggtgggaggattataaggttaggagttcgagattagtttggttaatatggtgaaattttatttttattaaaaatataaaaattagtcgggcgtggtagtgtatgtttgtaattttagttacgtaggaggttgaggtaggagaattatttgaatttgggaggtagaggttgtagtgagttaagttggtgttattgtattttagtttgggcgatagaaaaagattttatttttaaataaataaataaagggagagaagtttttgggtttttagatatatgggttagtgtttatttttgtaaagttgttgtgtttaaagaggggttgtatttggtggaattggggtaaaagagtagggagggtattgggtagttgatttggtttttattattggaaaggggttgtgttgttggtgttttgagttggttttataaggaagatattgtatagggcgttttaagtttgttttttttgtttaggtttatttttttttttttaggattagggagtttcgttcgttttttgttttcggtatttgttttttggtttgtgagtattgtatttttttttgtttggaacgtcggtttatggtgggttttcggatttttgttttttgttgttttttgttatatttcgttaaagtgtgttttatttatttattgttattattttttgaaatagagttttgttttgtcgtttaggttggagtgtaatggtgtgatttcggtttattgtaattttcgttttttgggtttaagcgatttttttgttttggtttttcgagtagttgggattataggcgaatgttattacgttcggttaatttttgtatttttagtagagatggggtttttttatgttggttaggttggtttcgaattgatttcgggtgattggtttacgttagttttttaaattgttgggattataggcgtgagttattatgtttggttaattattataatattgatattataataatattatagttagataacggtgattaacgtttgtaattcgaatattttgggaggttgaggtaggtagattatttgaggttagttcgagattagtttggttaacgtggtgaaattttgtttttatcgaatatataaaaattagtcggagcgtgatggtaggtgtttgtaattttagttatttgggaggcggaggttgcggtgaattgagatcgtgttattgtagtttaatttgggtgatagagtaagattttattttaaaagtagtaataataataataataataataatattatttattgagttttaattttgtgttaggtattgtgttagtatttgcgttatgtgattttattgattcggaataatttatgagtaagtattatttttgtttttaaggaagttgagatttaggaaatggaagttattttttagggtttatagtaagggtttggcgaggtttgcgtttaaattttgattatttgattttaggtttttttgttttttttgttttttaaaaatttaaatatttttatttgggatgattttagatagttagattttaattgttttttttttttttgagtatgttttattttaaaattatataaagataatttattttttaattggagttacggaatcgttagatgttttggagatttttttagttatttttttgttggatttagatataggtttgaataattaggtttaaggagttgaattggagtcgttcgtggttagaggtttttttttgggaatagtagtggcggtagcggttgcgttgagtttggtaatttgtttaagagtaggggatgtttaggttgcgttcgttttttttttatgaacggtttgttttgcgttttttttgtgttaagggttgttaggtattagatgtttattttaggaaattagaaaaataaatagtgtaaataaaataaaaattttatttaagaaatttgagatagatgttgttttttttatcgtttttttatttttatgttgggtttggagagagtgggttagtatgttttttacggataagaggttttggggtatttaatttggatggaattttttttattttttttttgtttggtgttagggggtagaaggtaggggtggtgtttatttggtttagggaggaggatagggtagtttttgtcgtcggtattttttgtagagatgttttagttagaagtgattttatttttaggaacgtgtgttttgttttttgttgggcggtttttttttattttttattgtttttatagtggggtgtgttagatttatgggtagagttttggtttatttttagtttcggatagtagaatgttttagtagtgtattgatggtgtgtgcgtggggatgtgtggaataggggatagtgatttcgtgtgcgttatatgtagtgcggtttttagtcgggtgtgtgaagggggtgtttatggttatcgtggaagtgagtttagttggggttggagggtttaggtttattgtatgttatttagtagttttgggagtggggtttattttttttttcgtttttttttttttttggttttgggtagtttatcggagttgtattttgggttattttttttggttttaaggaggttgttatttttgggaggtagatgttggtttttttatttttgttttttggagatttgcgtcgaggtttgtttttttgtttggagggattggttaggaatttttgggtttttttggtggggtttttgttgtttagtagtgagtagagtgagtgggtattaagaggaggatgttgggtgaggttacggatatggttggggtaggttgggggtgttggaggtgaatttcgtagttgtgcgattttgggtagtttgtttagttttgggtttcgtttttttttttatgaaatggggcgggagtatttgtttgttggggttgtgggttgggtgaatcggagttaaggtatagtttatagtttgtcgttagattttcgtaagtagaagtgggtgtttttgtttagcgtttttcggttttttttttaaggtttagttttgtttttattttttttatgaagtttttttggttattttaggagttacgatttatattttttttggagttttgtgttatacgtattttttacggtgttgttttttttggaggatgggtttaattaaaattggggtttatttgggggttttttttagtattagagaagtttaggtttagtagagatgggtattttgttaatattagtttcgcgaaggatatattgtgtttattttgttgttagttgttgagtttggtgttttgtagttatggaatatgtgtataggtttgggttgttggatacgaaggttagatgggtagtttattttgttttcgttttgagtttttagaaataagttggttgtatttatttttatttggttatagtttaggagtggggttgtggaatggatggaaggaaggatgagtgggtgggtgggggggtgggtgggtgggtggatggatggatggatgatgggtggatgggttgatggatgggtggattaggtggataggtgaatggattggtgggtgggtgggtgggtgaagggttgaataggtgggttgggtggatgggtggatggatgtgtggaggggtggtggggtggatggggtttatgggtgaatggatggatggatgggtgaatggagtaaatgagtgggtggatggatggatggatgttgtaagagtttttttggagggttttagggaggaattggtatttttgattagtagttagtatggtgattagatatagggaggtgtttgggtttgtttgattttttattttattgttggtgggattgggttggttatgtgtttttgaagttttttgaagggtggttgtatggtattgtttaggggatatttttagagtgtcgtgttttatagtaatagggtggtcgtttgtgtttttagggtcgttttttttggtagtttttcgggtttgtttggtttagtattttagtaaattttttcgagttaggatttgtttgttatgagtttttttaataagtagttttaggttaaggtttgtgtgtgggtagagggagcgtatgtcgcgggaggttgtattaatttgaggttttgtttttgtttttttttggggtaaaaggtaaaaatagtttgttttattttatttttaaatttagttcggttgtatttagttttgggagtgaagggggttgggttaggattgttcgtgagttgtagattttggtgtagggaaattttgatttataagacgggtggatatggaggaaggaggagatttcgtttagtagagatacgtttgggtgtagtttagtttggagtttgatggacgtgggtttatttgtgtgtaatttttatttattgtgtggttatagggaagtgatattttgtggagatttagattttttatttgtaaaataggggtagtagggtttgggggaggatgtgtgtgaaggtttggtttagggtttttttagtagttagatagtagtggttgttatttttttagcgtttagggttatttgggggagtagggtttttgtttttagatgggtttcgtttttggttttggaatttatagtaggagtaaaggcgaggatatttttggtgttaattatttattcggagggagagcgttagtggttttgtgtgatttttgttttttgtttttgtttttaggaggtacgcggatttttagtggtcggtttcggaggtttggtgattttagtggtttaggtaggtggttcgtttcgttttggttttatttagtttatgggtgtgtttgtgttggggtttttttattttggtttgggatttgtttttttatttggtttttttggatgagtggggttatttgtttattttttagggagacgtagtttttgacggttttggatttaggtggtttttaggtttgtcgacgttgttttgttggagatgatttttgtgggggtaggggtagttatttttaggtttagggagtaagttcgtgtgtgcgggatagaggagagaataggagatagatagggttggatgatttggtttgagatgttgaggggatagatgtgttatggataggtggttttggtcgtgagtttttcggtgttggtttagtatttgtgggttttttgtaattttgtaggatggaagatgttttaggatagagtagatacgttcggtgttatttaggaggaaataagtgggtttttggtagtggttattgtgttattttttgtgttttttttatgtgtttggaaattttttatattaattagtagggaagggaaatagatgtatttattagagttttggggttggtcgtttaggatacgagttatagtttataggtttgaagggattttattaatattgggtgtagtttgggtaagggagtgggatagagaggttagggttttgtttttagtttttgttttttagggttgagtttgcgcgttattttttttttattgggtgtttttgattttttttgtttgattttagtgtggttatgttagtgtttttgtttttgggagtttacgttgtttttggttgttatttttagcggttaggttgggataggtgtttatttagtggtttttttatttggagaggatgatgggttatagtaatgaatggatttattttttttaggagacgaggagttttgagaagagtagagatggcgtggttatttgtgtatatgtgttgggggttaattgggtgttagatttttggttgttattatggtggtagataggtagggattgtgtttttatgaattagttattttagaggagataaagttattaaaggatacggattcggagttaaatttatataaatagagcgtttgtggattagggttgtttttagaataaggtgagatagtcgttttgttaggataaggcgtttacgggggtaagggtatgtgtttatttggagtcgttatttttatgttttagattagtttcgtttaatagaattttttgtgatggtgggtttgttttatatatttgtatttcgttattttgtatggtagtcgtttagtcgtttgggtttattgtatatttaaagtataaatgtttacgtttattttatttatttatttatttgtatagaattatttatttattttaaatggatttttatttatatttacgtgtggttagtggttatgaaattgaatagttttagattatattggtatttgagattttagaattttagatttaaagtttgtttttgattttgagtttgtttttgtggggatagtatagacgttttttaagtttgttttttagaggtggatgtagtgttcgtggattgtgtattattaggtttggatagtggagagggtggttttttatagggagtgggagtggaggggatgtcgtgtttatattgagtgtatgtgaggttttttgtagtataggatgggattgtatgtgggaagaggggggtgatgttttggttggaggtttttgggtagttgtatgatttagcgttgtggttaagaggggtttcgtttatcgtagttatgttgggtattaattattggatagtttagtcgttgttgtgtttttggggagttttttttcggtttcgtatttgatttgtttttttattttttttttttttattggttagtttttggtggaatgggtggggagggttttttagtttttgtgggggttgtattttgggaatttggtattttgggttgtatggatatagtttttttcggcggttgtttttttttgtttagattggttggttttgtgttgttagtatttggtagttacgattatagtttagtttggaagtttaaggtataatttgttgaattttaaagttgtaagttggtgatttgggtttgcgtgggattgtttgttgatatacggggttttttttttgtgggtttttgtgggttttggttcgagatattttttttttatttttttggtttttttttttttttttgttttttttttgttaagattttggtttaggtaggagtttatttttagacgttttagtattttcggtttttttatttgatattttttagacgattgtttgttattttatttttttagtttagtttttttgtagatttatatttggttaattttttatgtttgggatttttgttttttttagaaggacgaaggtttttttcgaggttgtgtttgggattgggttagggatgatatttttggtaaaagtttaaatgatattatgattaacgttttggttagtttatatattttttttttttttaaaaaaaaaatggaatttttagagttataaaataaaaatgtaaagaataaggtaataaaatatttgtgtatttattatttcgtttaagaagtgagatattgtaggtgtagtcgtagttttgggtgattttttttattttagttttatttttgttgcggtgttcgtttttttggattgggatttggtttcgggtaggtatatttgtgttgggtagtggtgtgtttgagaagtttaggtttttttttttttttttttgagatagagtttcgttttatcgtttaggttggagtgtagtggtattatttcggtttattgtaatttttgttttttgggtttaagcgatttttttgttttagtttttttagtagttaggattataggtattcgttattatgtttggttaattttttttgtatttttagtagatatagggttttattatgttggttaggttggttttatatttttgattttaggtgatttatttgttttggttttttaaagtgttgggattataggtgtgagttatcgtattcggtttggtttttttttgtatacggttattagtatcgtgtgattgagtagtttaggtttgtttttttttgaatgtcgttattagtattatatttttggtgttttattggagttagtggttgttttgtttgtgtttataacgtgacggcgtggagatttattcgtgtagatttacgaagttttggtttatttattttggtagttagcgagtgtttttttgtgtggggaggtagagtttgttcgtttcgtggtttattggtgatatcgtcgaaggttttttttgttattagtgttgtcgggaacgtgtgtttttttaggtggatttggttgggttgtggagatgcgttttttagtttttttagatgttattattacgttttttcgagtggttttttggtaggtttttttatgttcgtttattttttgtgttttaggtagtcgtttttttgattgagcgtttagcggatttttgttttgttttttacggtgtacggagtattttattttagtggtgtttgagtttttttttttttggtttttagatttcggttgggatttttggagttaatttttttgtttgatatttcgtgtcgttaggttttgtttttttattttttaatatttttggggtgtgtggttttttttttagtgtttttattattttttttgttttaggttgaatcgtgttttttataaatttatgtttattaaaaattttagaatgtgatttgggagttggagatggggtttttgtagatgtaagtagttaaggattttgagatgaggttattttggattagggtgggttttaaatttaataattggtgtttttaaaagaagtagagaggttatagatatatcggggagagttacgtgaaggtaggagtagatgatggagtgacgtagttttaggttagggagcgtttgggaagaggtaaggaaggattttttttttattttattttagagtttttttagggagtgtggttttgttgatattttgattttggatttttggtttttagtatgggagagaattcgtttttatttttttaagttttatagttgtggtttattatggtagttataggatattgatgtattttttatttggtcgttgtggatggacgatttcgttcgtaggaagttttttttaagtattgtaggtgtttttgtttttataggggacgtttgtataagtaggtgtgaaaaaagggttttgtgggggtaaggtttgggttggtgttcgttgtttttttttattttatgttagtttttatgtttttttcggtaggagtgtttggttttatttggtgaattagagttaaatttttttgataattggttgttatttatttaattgttattatttttaggagatagaaaatgttagaagggtggggtttgtgtagtgttttttcgttatttttttagggtatcgtgttacgttgttttaatgtatagagtagttgtttaaagtgtgtcggacgaataggtgttttatgtttagttatgtagataaaagtgtgttacgtggagggagttggtcgtggaagagattattagtattttggttgttcgaggattttgtttttgggtttttgtaggtatttttagtttattatttttttttttatttatagttatttattttttttttatttttttgatattagttttgttatttatttaggtttgtaagtaggaaattttagagttgattttgatttttgtttttttagtatttttaggttttaataggttgttaagattttattaattcgttttttgtatattgatttttggataggttgtttcggttacggttatgttttggttgggtttttattatttttttttggattagtaggtgttattttttttatttttgttttgttgtggtttttttttttttacggttaatatttagaggacgattattatttttttttttgtgtgttggggatcgggtgataggatttttttattcgattatttttattagatttgggtcgggtttttttatttatagagtttttagttttcgtttttaaagtttcgagggtggattcgtgttgtcgtttagtttggttttgatatcgttttttagtttggagttttttgtttttgcgtttttggttttgagtgttcgggttttttttggatgggttgttatttgttttttggaaagtagggtttttatgtttttggattttttagttgatttagtgattttgggttattttgttatattttttttattagtttggttttggttatttttgtgttttttatagtttcggattagagttacggcgggatgtttttttggtgcgtggtaggtagttaggaaatattgttggattgattttgataggagatgtttgggagaattgtttaaaaaattagtttaaaatgtaaatattggtttttttttgcgttggttaaagagtagtattttttcgtttgtttttcgggtaagaaattgatggcgaatgtaatgtttttagggaggagaagaaggtgataaaaagggtttgtataacggggtatacgttaggtatttgtgattatttaagtttaaattataatataaatgcgaaattttttgttttggtagtttttttatattgtaagcgtttattgttatatgtggttgttatattgattacggtagatatagaatattgatattattgcggagagttttatgggggggcgttggtttagattatttttacgttggatttataaatttattgtttatttagtgaacggttattgggtatttattgagtaagtaggatgaaagatattcgttttcgggggagtttttcgttggttgtagagaagtttaaatttaggggatttggggtaaattttgtaagggtttttggtttttgtatttttagatttttttcgttttgtaggggtagtcgggggttttttttaggaatggagcgttagttttagtttttgttaggttatagtttagatggttggttgagtacgagtatgtgagagtggaattgggtttaatcgggttgttttttttcgttgttttggtttttttttacgttgatttggaaggatttttaaagtaataggtttgtttaggcggtttgtattagtaaattttgtagcggttttaagggtagagatagttggattgtatttatttaggaatagttaaagtttgaggtataataaaaagtggagaaagattttagagaggaatgtagttggttttagtttgggaattcgttttgtttgggaggttgtaggcgggttaggttggggttagtttggagggttttggttggttttgttggtaggtatagtagtagggttagtaggagggagtttaggacggagtttttttatttttaatttagggaagtaaattttagtggttgagtttgaggatgagtaggaaatgaatggaaaagtttttttttttttttttttttttttaggtagggtttttttttgttttttaggttggagtgtagtggtataattatagtttattgtagttttaatttgttaggtttaagggatttttttgttttagttttttaagtagttgggattatagttgtgcgttattatgattggttaatttttaaaagaaatgtttttaggttaggtatggtgatttatgtttgtaattttagtatttttggagtcgaggtgggaggattatttgagtttaggtgttttagattagtttgggtaatatgacgagatttcgttttgattaaaaatataaaaagttagttgggcgtggtggtatagttttgtagttttagttattcgggaagttgaggttgtagtgagttgtgattacgttattgttttttagtttgggtaaagggagtaaggttttgttttaaaaaaaaaaattttttttttttttgaggtggagttttgttttgttgtttaggttggagtgtagtggtatgattttggtttattgtaatttttgttttttaggtttaagtgatttttttgttttagttttttaagtagttgggattataggtatgagttattgtgtttggattttttttttttttttttttttttgtagagatgggatttttttatgttgtttaggttggttttgaatttttggttttaagtgatttttttattttggttttttaaagtgttggaattataggtgtgagttattatatttagtaggaaaagttattttttaaagcgagaggttgtgcgttttttatagtttggcgtttattagtatggaggatttattggaacgtgtgttaggtgaggggatatggaagatggtagtaaattcgagtttagagtattagaaagtatgtttttagttaaagatgcgttttttttattttcgcgtagtatttttttttagtgtgtatttttggagtaaggtggggtcgattttacgaagattttttttcgaaggtttttgttgtttatattagtgttatttggatcgtttgtttttttttttggatggttggattagttttagggttttttggtttggtgtggggagtatagtttattttggggaatgtttggtatgtgttttttttttattgggtattaggggatgaagttgtgtttcgtggaaggggatagaggcgttggtgtttaggatggtgtatttggggcggttgaattggatttggtttttattgggtttttgtggagtttagattgttgtgagaaggggtggggaaaggtaggtgattcgtattttttatttttgttttatatgggaataggggtttattttgtatatatatttagtttggagtatgaatttttatgaagaggaaaatttttattaggttttgatgttaggattgttcgtgagggtcgggtcgtgttttggggtaaggataggagtggagggggtaattagggaaggttttttaatggaggaggtatttgatagtattttgaaaaagaagtagtttttaggttaagttagagattgaagaatgattatttaattttttttttttttttttgagatggaatttcgcgttgtcgtttaggttggagtgtagtggcgtgatttaggtttattgtaatttttattttttaggtttaagtaatttttttgttttagttttttgaatagttgggattataggtatgcgttattatgtttagttaatttttgtatttttagtagagacggggttttattatgttggttaggttggtttggaatttttgattttgtgatttatttgtttcggttttttaaagtgttgggattataggtatgagttattgtattcggttacgattatttaatttttttttataagatgttttttggttgacgtaaagtaggttgagtgagtgtgatattttttttttgtttgtgggtttcggtttttttagagttcggttagtgttattggagataaagtggttttcgtttttttttttcgttttgttaggtttagtttgtgtcgttgagttttattttgtaattaagaggagttgtgaattagtgatgttgatgtcgtagaaaagtggttaggggtttatggggggtgaaggatagggatgtcgttttgagaattgtttggaaggggtttttgggtaatagtgtttattttagggtgtgggtaggttggggtggttgggagttgggtttataggttggtataattagagttttttaaagtcgtgggtttgagggttttgtttttttgggatagtaatttttggtttaatttgggaaaaggtgggttaaattaagttcggtttttttattgtaggattatttagtgcgtttagtatgtaaatgtgtttttgaatttaagataggattatagaaatttttttagtgtttttttggagggagggatcgcgggggatttatcgtaggggtttgggtttgtattggtttggtgaagtgtttttttagtgtttatattatgcgcggtgagaggttggttttcgttttttttattttttgttggttttattttattatttttgtattcgttttttagtcggtttatgattaatttttgtttttttagagttaatcggtgttgttaggttttttattttaagtgatttttcgtttgggttaaaatgtttggatttttaggtacggaggggagatggattttaggttaaattatgttgggtaaaattgagggttaaggttgtgtttagtaagtgttttagttttggtcgttaaatttatagtgtgtatagcgtgtaggaggtggttgggtgaatgaatttagttatagttcggttttttattcggggttgtttttaagtttttatcgttagttaggttgggttagagtttcgtggggtttttttgggtttttttgttttatagtaggagttcgtatggagagtttcgagtgaggttaatgggtttttttttttttttttttttttttttttaatttgagatagggttttattttttttatttagttagggtgtagtagtgtaattatagtttatagtagtttcgaatttttggttttaagtaattttttcgtcgtagttttttaaagtgttgagattataggtacgtgttattttgtttagttggggtttttgttttttatttttttttttgtttttaaatttaatataaagaaagatattatatttataattagaaaaattaataaggaatattattttaaaattggaaaagggattaaagaaataaattaagaaatttttgcgatttttgtttatcggagttagtggttgttagtggttggtttaatataatgttttaggaagaaatagaataatagaaagtaattttagtgagttgagttttggtttcgtttgtggcgttgtattagttttttgtagttgttgtaacgagtggttataagttggttgggttataataacgtttagttatttttttatagttttgtaggttatatattcgagattagggttattaggttgaaattagggtgtttattgggtatagttttttggaggttttagggtaggggtttttagtttcgtgtgttttattaggaattggtttgtatagtaggaggtgagtgattggtaagcgagcgaagttttatttgtatttatagttattttttattgttcgtattattgtttaagttttgttttttgtttgattagttatggtattggatttttataggagagtgaatcgtattgtgaacggtatatgtgagggatttaggttgcgtgttttttatgagaatttgatgtttgatgatttgttatcgttttttattattattagatgggatcgtttggttgtaggaaaataagtttagggttttaattgattttatattatggtgagttgtataattattttattatatattataataataatagaaataaagtgtataattaatataacgtgtttgtggtcgggtgtagtggtttatatttgtaattttagagtgaaattttgttttaaaaaataaaaaataaaggttaggtatagtggtttatgtttgtaattttagtattttgggaggttaaggttggcggattacgaggttaggagtttaagattagtttggttaatatggtgaaatttcgtttttattaaaaatataaaaattagtcggatacggtggtaggcgtttgtagttttagttttttgggaggttgaggtagaagaattgtttgaatttaggtggcggaggttgtagtgaattgagatagtgttattgtattttagtttgggtggtagagcgagattttgttttaataaaataaaataaaataaaataataaatataatatatttgaattattttaaaattatttttttattttttggtttgtggaaaaattgttttttttgaaatcgattttaggtgttaaaaaggttgggggttattgtttttatcgtttgtttttttgagtttttggtggttgtgggtgttttttggtttgtggttgtatggtttttatttttaatattagtatttatagattttttcgggttttatttttatttggttatttttgtttgtgttaaatttttttttgttttcgttttgtatgagtatcgagattgtttttagggattatttagattatttagggtgttttcgttatagtaagatttgtaattgaattatagatgtaaaaatttttgttttaaataaggttttatttgtaggtttagggattaggatatgttatttttggggttattatttagttttttttcgtgattatgatttttttttttttttttagttttttatttcggttgagatgttgtttttattttttttattgtttggttgtttgtggggttgttttttaggttttttgggaggaggtggttgtttgatgttttttagaaggttgggaatggttttttttattttttaggaagatgttttttttgttaaggagattgtatttggggttttattttaggtagagagcggacgggattgtggtttgaagtggtattttagggtttttggttttgttatttagtcgagggttgtgtatgggttttatttggttataggtaatttatttggttttgtggggtagggattgtaaatttagaggtttgcggggtgtgtcgaggtagaggggtgtaaatattgtaaatttgttgggggttttggggagtagtatagattgaaaagtgttttgtttgaagagtagaattgttttatattagttttgtgcggttaggtaggaaggttttcgtggtgcggttacgcgtttttttttttttaatagaagttgatagtttggagtttttagagagattgtttgagtttttagttttggtataaatatatattttttttaaataggtttgggttaatagaattagttttcgtgtttcgggtttgaatgaatttttgaggtgaagtttaaagatagagaggatgtttttgatttttattttagggatttatattgtaaatttttatttgttttgttgagtttttggttttagtatggattttgattatgtgttggtggggattttttaggtaagtaagtagtttttgaggatttcggatgaatagtggggaatagtattgattttttagtggggtttcgagttttcggagaggaagattcgtttttttttaggggacggttagagatttattgatttatgcgtgtgtggtaggaattttttaggaagttttcgtttcgttcgttttttttgtttgggcggggacggtaattgtttttgttattgtagattaatgggacggaggggggtgattttttagggttttttttgggtaggtgtttcggaatttttttttagtacgttggtttggggtacggtcgttttttttgtttagttacgttggggtatagggtgaagaagggttggggttagtttaggatagaggaaggcgaggtaggtacgtaggaattgggttttttaaatttttaagtttaaggaaatcgtagtatcgcgggatagggaaaatgaaagattttggaagtcgttaggaatttgattttgtgagttggtttttaagagtttaagttaagtatttttaagtggatattaaaaaggagtagtaagtttcggggcggcgggggttggaggaggtggagagaggaggttgtcggaagtcgtattcgggatttttgtagttatcgattagatcgggcggtcgggattttgggattttcgtaggtagattcggtggtttgtcggatttttcggggtttatttcgggtttttttttttgttttttatttttggattttttttttttgtttttttttttttttcgttttgaagagataatgttattttagtttggagtataaatatatgattagtatatggaaatgtggtaattcggatgtattcgtgattgtaatagattgaagaaattagattagataaagagtgtttttagaggaggaggaggaggaggaggaggttgagagagggagggcgacgggggtgagaaaggggaggtcgtttttgagcgggacgtcgggattttcgtcgttgttaaatatattcgtaggaatggagagggatcggattttaggtacgtagatagttttttttttatcggtcgttttttattgttttggattcggggttttatttatgtttgggggaataagtatgtaaagggcgtttttgtttattttttatagaaatattttttttttttttgacggttttaagttcgtgggatgaatttcgttttagaagttaagtttttttgagtttggtttttatttaaattcggttttttttttttttggttattttttttttattttttagtgtgttatttttgtatgttatggttattgttaatgttgaggttgttggcgtcgaaattttgggagggtgtgggggatttgtttttttggttcgggtttggggcggcggcgtttggatttggttggtggttggtttgtttattgtgtggtttgttttttgtttttagttaaagtttgtttttaaggttgtttcggttttttatttaaaatagtatttttgtgtttttttggtagttgattatagagggggaagttttcggcgtttagaggagtttggcgtgtgtgtgtacgtgtgtgtgtatgtgtgtgcgtgtgtttatttacgttggtagtttttttgtcgtaggtatagatttattagggcgtgaataggtaaatgaagagaaagggggtttttttgtttttagtttattttagttttttaggtttttttttttaggtttagtttttttggtttttttatttatatgcggtgtcgtggttgttattttacgtggttagcgtcgttatcggtaattagtagtgatgatagtttttgtcgtttatgtcgttttttgagtttagcgttgggagatatggggtggttgagttaagttttaggttttgggtattttgaagtgatttacgggttatggagcgggaggtcgttaagagtgttaatttttacgtgttttgggttttggtttgttggttgttattatgtgtgtgttggggggtttttgagaggtttgagagagggaggtttatttcggtggtttttttttaggacgtgtggttttttttattattgtttttagggttatatttttttttttttttttttttgagacggagtttggttttgttgtttaggttggagtgtagtggcgcgattttagtttattgtaagtttcgtttttttagtttatgttatttttttgttttagttttttaagtagttgggattataggcgttcgttatatttttttgtatttttagtagagatggggttttatcgtgttaattaggatggtttcgattttttgatttcgtgattcgttcgttttagttttttaaagtgttgggattataggcgtgagttacggcgttcggttttagggttatattttgattgttacgttgggattggtggagcgggtgtgtgttgtgtcgttgagtatatttagtcgggtatagtaggcggattttaggagggggttaggggagacggtagaaggtttgggtggtagtgaaattgtattttatttgtttgagttcgggggtttaggttcgttgggacgggtgggtgtggagtttagcgttttgtttttcgtttagtaggagtcgtagggtagggagcgttgagagggattttcgttaggtttgtatagtggagtcgttttcggagtgattattttattaggtagtttgggtagattatagtgggttttttgttttttgggttattagttttaggaggacgttattttattcgtttggttggtaggggtttcggggagtttcgggttcggtttttattttatagatgatttagtcgaggtttagatgggtgattagtaggggatttgagagttgagtagagaggcgtgggtttgggggtggtgttttttggggagttggaagtgatggtatttttttaggtttataaaatacgggttttttatgaattgaataaaatattttttgaaagtagttagtgttgtgttttagagattattttgatttttgttgtttttggttgaggatagtatagttagggatgaagcggggattttttttcgggttgtgttttgatgaaagatgttttttataaaattttattcggatgtgtttttatgtaagaaaacgtatatttttagaaatttagttgtaaattggttgtttttcgaatgaatacgatagtttcggagttgttttttttaatgaggttttcgttttgggtaaattttagcgttggtttttaattgttattgaattttcgtatagtttttggggaagtgattttttttttgtttttgttgggtggttttgagtaagttatttggtagttttgggtcgtagtttcgttatttgtaaggtgaggggtgggagcggtacggtttttaggtagcgtttttattttttgcgggtttttgcgcgtgttttgagttttgtgggcgtttttttttttattgaggggttttttttttttgtagggtatggtttacgtcgcgttgttaggttgtaagttattgcgagagttgttttgatttttaagtatgttttggtttgaggaggagttatggggaggacgttgtgtttgtgtgatagaggtttgttcggtagatgtcggttcgttgatttttagacgtggttgtgggtgttttatgttttattgggttggcgtgtgaggcgtgtttagtttaggttgttttatagttgtttaggaagggtttgtgggagggggtggttttattttggtgagtttacggtggtttgttagttttagggaaggtttaggagttttaagatttgtttttttgtttttttttcggtagtgtttggtttcggtttggtttgtgaacgggggtttgggtattttttcgttttttttgggggttgtggtttttttttgggaaggtgttggagggtttgttagtagggtcggtatgagttatggagtggtgattggtcgttgaggtatggaaggttattttttttagttaagggtcggagttttttttttgttttggaacggttttgtggtttttataaattaagtagttttattttgttttaagagtttgtattttagtagggagagagtttttaagaagggaattttttattggggagttttgttgggttgggaggttaggaataggttacgagggagggttgtaggtaggggaagtggtcgtttgtgtatggttatgaatgtaggttcggggttttggagggggtttggttacgttgtcgttggacgtttgtttttattagggtttatttgatgtagtacggtatagggtaaagtttagttttttttacggggtttttgggttattagtgggcggggaatcgaggttttttggagggcggtgttttagtttttattttttttttttgtttttcgttgtgttgttttcgatggtttttgttattttttgggagtttttatttttggacgttcggtgtttgttcggttttaatttttttagttttgtttttttattttcgaggtgagaggtttggtttgacgcgttttgtattcgttttttgtttagtttcgtgggaattttggtttttgtagtggttttttggggttgttattattaagtgttataaattgggtggtttaaaatattagatattttttttttcgtcgttttggaggttagaagttcgaaattacggtattagtaggtttggtttttttcggaggtttcgagggggagtttgtttttcgtttttggtagtttttggcggttttcgaaatttttggcgttttttggttcgtggttatattattcgatttttgttttcgttgttacggggtttttttttgtgttttaaatttttttttgtttgttttttatacggatagtttttttcggatttagggtttattgggtaatttaaaatggttttattttaagatttttaattttataacgtttgtaaagattttttttttaaataggttatgtttataggttttggggtggatgtaaattttaggggttattttttatttttttgttgttttcgtgtgtttggatgtatagtatggttttatgttttagattttttgttggatttttttggttttttggggtggtttttggttttttttattcgtttttgtgtttttggtgaggtgtcggggtcgggtttagtttttgtaggaattttggggatagtatggagtcggtaattttttattaggcgtttttttatttgtttagagtttatggttgtgaggggtttttttttgtggttttgatttgtaattttttagtggttagtgatgttgagtattttttcgtgtttattgtttatttgtatatatttttgtagaaatgtttgtttaagttttttatttgtgtttgatttggatgattgttgttgttgagtgttaggagatttgtagattaatatttagatattaattttatatttgatttatgatttgttgttattttatggattgttttttttttacgttgttagtgttttttgatatgtaatttttttttttttttttgagatggagtttgattttgttgtttaggttggagtgtagtggtatgattttggtttattgtaattttcgtttttttggttttagcgatttttttgttttagttttttgagtagttgggattataggtattcgttattatatttagttaatttttgtatttttagtagagacggggttttattgtgttgattaagttggtttcgaatttttgattttaagtaatttattcgtttcggttttttaaagtgtcggagttataggcgtgagttatcgtatttaggttgatatgtaaatattttaaatttttatgacgttttattttatttatttgtttttttgttgtttgtgtttttggcgttatatttaagaaattattgttaaatgtaacgttaggaagttttttttttgtgtttttttttaagagttttgtggttttagtttttgagtttaggtttttgatgtaagttgagttgatttttgtatgtggtgtaagggttggtttagttttatgttttgggtttttgatttattttttttttttttttacgtttagttggtttcgttgggtggcggggaggagtggggaagtttcgggttgggtttgtattcgattatttttttttaggttagttagggagttttagtttttgtttaggatttggttggacgtgttttttatcgggaaagtttgggtcgtttttttaggttgatggtagggttagttcggggcgttttgaggtttgttttgcggatatgttttttgttttaggtggtgtggttgttcggtttgcgtgtgagattagttgtttgtgttttaggttatggaggttgagtgtttttagtttgtttttttgttcggttttttttttggggaagtttttgtagtttattttttgttttcgtttttgttatttgtgtttttgtttgttttttgtttggaggtggttatttttggggttattttttatgatttggatataagtttttattttgaagttattatttaaatttttgtgttttaaattttttttatttattatatgggtttttattgtgattaatttagtagttgatgaagttttttttggggtttttttagtaacggggagttggttttttcggaggtttggtttttttttaagtggaagtggggcgtgagggtgttagtttttttttgttgtttggtgttttaggttggtttgttatttttggaagtatttgttatttttatatagtattttatatttattttttcgttttttatttttttttttaaggggttatttttgtttttttttttatttaattttatttatgtggttcgtttagtaatttttgatttttaatatgataaaataaattttttttgtcggttatttatttatttatttagtattgggtgttttttgtggatttggcgttggggtttcgtggaggataaagttagatatagtttttgtttttatgggattgtataagtgtaagattatattagtaaacgtgaaatataggaagtgataggtgtgataaaggggattagtggtaggatagaatttgcggttcgtaggattaggttaggagggttgtttcggggggatattttcgggttgagcgtagaaggatgaggggagtaaattaggtttaaatttagtaggtagaggcgatcgttgtaggtaatcggtaatgtgtttaaaggttttggggcgcggggggttgaggtcggtagtacggtaggaagtaagattggggttgaaagagattgattgttatgttgtgaaatatatatttggtttttatttttattttttggtatataatttttaaaatttttggaatttttaaagtgatgtttttttggatgtttatgattgatagattagttggtagttttaggatggtttttagggaagattaggtagaattataaggtttagtattatttcgtaatttttaggtaggggagaggggttgaaggttaagtagattattagcggttaatgattgaattaattatgttttcgtaatgaggttttcgtgaatatttagaaggatggggtttcgggagtttttggatggatgagtatgtggaggtttttggagggtggagcgtttggggagtatatggaagttttgcgttttttttttatattttgttttatatatttttttttttgtattttttgtaatattttttataataaattagtaaattttatgagttttaggaatatgtgtaaaagaaaaaaaaaagaataaattatagttgttgtagtaagttaattttattagtattggtttttatttgtcgattttatttttggtaatgttttttttttttgggtttttgggattttttcggttttattattttttttgtagtggtttcgttggttgttgtttttaggttagtttatttttattcggtttgtttttattaggggttgaggtttttttgtttattttagttttttggttcgttttttgttttgggtatttttttatttcgaacggttagagtttttgaagtcgttcgttgtgtgttttcgtttggttttatgtatttcgtacggtgttttttagggttttttattggtaagggtattggtatagattttggggttgttttggtttaagtttattttgatttggagtttgagggtttttgagggggttttgaaggttagggtaggtaaggttggtatgttttgggtagtgggggttgggtatgggaggggatcgtgggtggggagattttttttaattagcggtttacgtttggagattgatttgggttttaggttacgttttgaaattgggatagagagtggcgtagattttagttcggagattttttttgtttgtggacgtttttatatttttattcgtggagttatttttttttttttttttttaaatggggaaattttgatttgaatattgaataaataatatattttcgaaattagcgaagaggtattggttttgaaattttgttatgaaagtttgaaaatgttttttggatcgatttgttggaatagacgggtgtgatggggttgcggggttttaggtggtaggaggcgttttcgtgtttagggtatttcgatgtttagagttttttcgtgtttagtgtgtttttgtatttagggtatttttatgtttagggtgttttcgtgtttagtgtgtttttgtatttagggtatttttatgtttagggttttttcgtgtttagggtgtttttgtatttagagtatttttatgtttagggtgttttcgtatttagggtgttttcgtttttagggcgttttgtgtttagggtgttttcgtgtttagtgtgtttttgtatttagggcgtttttatgtttagggtgtttttatgtttaggtattgtttttttttatttttttaatttttttttattaataggtgttagttgtgaaatgtttgttgtgtgtgttttttggttgagtttattttgtgtttttaagtttttgttagatataggtaggttgttttagtttttttggtaaatgttttgttgttgttgtttgatacggggttttatttcgttatttaggttggagtgtagtggcgttatttcgttttattgtaattttcgttttttaggtttaagcgatttttttgttttagttttttaaatagttgggatgataggcgttcgttattatgtttggttaatttttgtatttttagtagagatggggttttattatgttggttaggttggtttcgattttttgattttaagtgatttatttagtttggttttttaaagtgttgggattataggtatgagttatcgtgtttggttcgtttggtgaatgtttattgaggtttattatgtgtagttttttttttaggtgtttggtttgtaatgaggagtaataaagatatagtcgttggtcgtttgttatttaatagttggaattgagaggtagtttataaatgagtaaatttataggtggttttagatgaggattgtgaagaagttaagaataggttgttgggggtgtatatttgtgtgtgtggcgaggggattaatggaagttttttttgagtggtgatattgagttgaagttgtaatgattagaaggatttagttaggttaaaatttaagggaagagtaatttggtaaaggaaatagtaggtgtgaaggttcgaggttggagtttggggaaggtgggagtggttggagtgtgtttttagagacgggttatggtgatattaatgcgataggtagggttaggtcgtgtcgggttttggaggttttggtgagggtttgattttatttttattatggtgggattttagtgttttgtggttgttgagaatggttaggggtaggtagggaggtttgttagggaggaggttgttgtaggttttgtagttggagagggaggattaggatttttttagagaggaagttggagagggaggatttttttgattgttggatggatttatttgtttggttgttttcgttagtatttagtagaggttattggatgttgataggtggtcggttttgtttagttttgtattgttttgtgttgttttggtggttgtcggttttaggaggagcgtttttggtgtttgagtttagtggttttggttgtggtttggtatatttggtcgtgggtgaggttaaggtggtttggattttgggaaggttgggtatttggtagttttaaggtaggagttggggtgttggaggaggaagtacgtttatttttcgtttttttttgtttcgtgggatgttgagtttttgggtagggatatggtgagttttggtgtgatgtatttaatatttgttggtgtttttatttttaagtaggaattttggtgtttggtgtttgaggattgttgtttatcgttttattattttttaggtttttttttagtttttgattcggggtaaggtttagatatttagaatatttttggttggtttttggagttggggtgaggtagaattttttttttatatttatagtattagttaaggtttcggggtttggatattatttttgggaggggtgagtaggataagtgaggtttttagatttggggtggtttcggattggttaggtaggtgggtgggggttgtagtttatgttttcgttttaggtaatatagtcgagttgtagttttcgttttatttttagttggggttttttgtgtttattttttgttttttttttttttttcggaatggggggtggatattttaagattagttttttagttattttttttgttttttgttttttttttttcgggatagatttttgtgatcgttgggtgtttttgatgttttgttttttttgcgttttgtgtcgtgggtgagagagggtttcggggggattttttttttttggagtatttgttgtttcgggtgtttttgggggcgggtttttattttatattgtggagttggtgtaggaaggaaggtgtcgggagttagttttaatttacgtgttggttgtggtttttaaggtgtggatggtaggaggtggtgagatagggatttattgattatgggattgatatttttttatgttgatgtgggttttgagttataattttattagtttttgagttttggcgttgtttttggcgatggcgtggatttagttaggttttcgggtagttttttttggatttttttttcgtttttttttgggtagtgtttttgtttatttggaaaggatgggtaggatttggagataatagggatttaaagaagtcgggagtgggggtatttgtgtagtttattttgtagaatagataatttggttaaagtttaaagtttgttgttaggagtttcgtttgttttttagagagtatatggtttgattattacggggattgggggagaggtataggtatgtttgttcggtagtagaagggaatttcgggtttgggtttttttattttgtggcgttgtttttttttagagttgtattgttttttttattgtttttgtttggttttagtgtttatgtggtttgtggtttttagtttgggtttggtttttcgtaatttattttgtttagttttatatagtttgtttttttagttgggaatcggagtttatttggagttttaggtagtagattcgatgtagtgatgtagggttgttagttatgttagtaggttttgttgtttatagagggatgggtattgttgttgataataattaaagaattacggttttaggttgggtatagtggtttatatttgtaattttagaattttgggaggtcgaggtaggagaattaattgaatttaggagttttagattaggttgggtaatatagtaaggttttgtttttataaaaaataaaaaataataataataataaaaattatagttttagaatgattgattttagtatgtttataaagttaagggtttttagtgttttgggtttatgttattgcgttagagggagagaggaagaggttggggtgatgggtattggggtttatgttttttttggaatgggtggttttggattgtgtttgtgtgatatgtttgtcgagcgggggcggtgtttattgaggattggatgttgaggtgtgggtggggggaggttatgaagtattgggtatttttcgtgtattagtgtttcgagattgtagagaggggattcgtttagtttgggtagggaggcgggtggtagcgaggaaggggagaggaattcgggtgtagaaagttttttttttagtaggtggcgtcgtaagttttcgagagtttagtttttgcggggtttgtatttttattgaatttgtgggtagaggttgtttgggtgtagttttcgttaattgtgattgtttattgcgggcgaggggaagtggagtgtagagaatgtatcggagggtagatgattagttttcgtataggtacgggggtgttttttttttcgtataggtacggggggttcgagtttttggggtttttgttttaattgggcggggaaagggagggttggaagttgagttagggggaaagggggtggttttttgttattttttttattttattttttttatttttggttgataggttttaattttttttatatttttttaattttttgtcgtaaaattttttaaatatagaaaagatgaaagagggttgagtgtggtggtttatgattgtaattttagtattttgggaggttgaggtaggaggattatttgagtttaggagtttaagattagttcgggtaatatagtgagattttatttttataaaggatataaaaaattagttaggtatggtggtgtaggtttggagttttagttattcggaaggttgaggtgagaggattgtttgaatttgggaggttgaggttgtagtgagttgggattgtgttaatgtattttagtttgggcgatagaataaaattttgttttaaaaataaaataaaataaaattataaaaaagaaattatgaaagattttaaagtaaatatttatgtatttattatttagattttatagtaattattttgttgtttgttttattataaatttttttggttattagtatttacgttggttttgatgtatttaaaataagttgtagaaattagtatataatattttgttaatattttagtttgtattttattaattagagttcggtatttgtttgtgattatttttgtttttttttgaagtaaaatgtatatattttgagatgtataggtgtgaaacgtttcgttttttgaattttaataaaggtatttacgtgtattttagtttgattagaatatagaatattattattattttagtaagttttttatgtttttttaggtgtattatagtttttattttttttagggtaattataattgtgttttttttttattacgaaataattttgttagtttgagtgttttttagagttatttatgttgttgtaggtgttagcgatttgttttgttttattgttgagtaacgtttattgtgtgaatattttgtgggtttttagttatttttttgttgaaagatttttggttgtttttatttggaggtttttatgagtaaatttgttacgttggttttttttgtataagtttttttgtgtatatgggcgtttatttattttgtagaaatatttagagtaggtatagggtaggtatatatttagttttataagaaattgttagatttttttttaaagtggtttttttattttatatttttattagtaatggatacgagttttagttgttttatattttggttaatatttggtgttgttattttgtgaaattttagttattttggtgggcgtgtagtggtattattttattatggttttaatttgttttggtttgatgattaatgcggttgagtatatttttatgattggttttttatatattttttttttgtgaaatgtttttttaaatttgttgtttattttaaaattgggttgtttgatttttttttttggatattgattttttgttagatacgtgttttataaatattttattttagtttgtggtttgtttgtttattttttttttttttttaagaataaggtttcgttgtattgtttaagtaggtttgaaatttttgggtttaagttgtttttttgtttttgtttttttaagagtcggttttataggtatgagttattatgttcggtttgtttatttttttagtggtattttttaataagtaaaagtgtgttattttaatttttatgaagtttaatttaataaatttttttttttgtggttttttttttgtgttttttgtaagaaatttttgtttattttgttaaattgtaaagatatttatgtttttttttagaaggtttagagttatatagtttttatgaattaatttttgtatatggtgtgaggtagagggttagggtttattttgttgtcgttttatgtgtttatttagttgttttaaattttatttttttttaaagtttttattttgtatttttttggtgatttatgaggtcgtataattttttaagatttttgttggttatttacgtatttttttttgtaaaattatttgtttacgttttatttttttttaaaattatgttgttttaagatcgagtgatttttgaagtttttattttataatgtttgaaagaatgaatattttgttttttagttataggtttttgttttttgttttgtagttgtatagtggggtaagatttgggttttgttttgttgttgttttgttgtttttttatttgattgtttttttatgggttttatttaaaaaaaaaattggtcgggtatagtggtttacgtttgtaattttagtattttgggaggtcgaggcgggtagattacgaggttaggagattaagattattttggttaatacggtgaaattttatttttattaaaaatataaaaaattagtcgggcgtggtggcgggcgtttgtagttttagataatcgggaggtcgaggtaggaaaatggtgtgaatttgggaggcggagtttgtagtgagtcgagattgtattattgtattttagtttaggtgatagagtaagattttgttttaaaaaaaaaaaaaaaaaaaaatgttgttttatatgttttttatatattttggatataagttttttattagatatatgtattataagtttttttttttatattgtttttttttttttggtttttttaatgatgttatttaatgagtaagagtattttgtttttataaagtttaatttattaattttttttagtttcgatttatgatttttgtgatttatggaggaaatttttgtttatattaaggttaaaagaagtttttttattttttagaaattttatagttgtatattttatgattttttttattttttaattttttaaatttttatattttttaatttattatagtcgttaggatgttgtatgatttattttaaattagtttttgtatttggtttgaggttagggttaatttttgtttttttatatttatatttagttttagtatcgtttgttgaaaagatatattttattttattgaattatttgatatttttgttaaaaattattgattgtatatgtggttttatattagtatatgtacgtatatatatgtaggttttgtgttgattgtatgtgtggttttatattagtatatgtacgtatatatatattggttttatgttgattgtatatgtggttttgtattagtatatatatattagttttatattgattgtatatgtggttttgtattagtatatgtatatatatatatgtaggttttatgttgattgtatatgtggttttatattagtatatgtatatttatatatgtaggttttgtgttgattgtatatgtggttttgtattagtatatgtatatatatatatataggtttcgtgttgattgtatatgtggttttgtattagtatatgtatatatatatatgtaggttttatgttgattgtatatgtggttttgtattagtatatgtatatatatatatataggtttcgtgttgattgtatatgtggttttgtattagtatatgtatatatatatatgtaggttttatgttgattgtatatgtggttttgtattagtatatgtatatatatatatgtaggttttatgttgattgtatatgtagttttatattagtatatgtatatatatatatgtaggttttatgttgattgtatatgtagttttatattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatatatatgtggttttgtattagtatatgtatatatatatatgtaggtttcgtgttgattgtatatgtggttttgtattagtatatgtatatatatatatgtaggttttatgttgattgtatatgtggttttatattagtatatgtattgtatatatgtaggttttatgttgattgtatatgtggttttatattagtatatgtattgtatatatgtaggttttgtgttgagatattattgtgtttttttgatattttgtttatttttttgttgatgttatattttgattaatgtggttttatagtaagttttaatataaagttttttaaatatttaaaatattattttgaatattttaggttttttgagtttttttataaatttaagaagtagtttgttgatgtttataaaaatgtagtgtgaattttggttgagattgtgttgaatttgtagattaattaaggaagaattggtattttaataatattgagttttttgtatagatggtatattttcgttttaaaggtttttttgtattttttttatttttttattgaaaaaaaatttttatagaattatattgttttgtagtttttaagaaaaagattttgtatgttatttgttaaatttatttttaagaattttatttttggtattattttaagttgaaatagattttaaattttatttttaattatttgttgttagtatgtaaaaatataatagatttttgtatgtaaattttatattttatgattttttttaaagttatttattattttggtaatggttttgtaggttttttaggatttaaatatatagttttatttttttttgattttgatgttttgttttttttttttgttttattgtattggttagagttgttagtttagtattgaatagtagtgattagtggatatttttgtttgtgttaaatttataatgttaattttagatttgttatatatgatttttgttagattgaggaaatttttttttatttttaatttgttgaaattttttaatatgaatgggtatgattttagtaaatgttttttttgtatttatggaaatgattattgttttgttttttattcgtttaataggataaattataatgattgatttttgtttttcgttttttttttttttttttttaaagaaatagagttttatttttgtttaggttgtagtatagtggtgttatcgtagtttattgtagtttgaatttttggatttaagtaatttttttattttagttttttaagtagtagggattataggtatatgttattatgttaagttaatttttaatttttaaaattttttgtatagatggggttttattgtgttgtttaggttggtttgtaatttttgagtttaagtaatatttttatttttgttttttaaagtgttgagattataggtgtgagttattgtgtaggtttgattttttaatattgaattaattttgtatttttggaagaagtttaatttgtttatgagatattattttttttatatattgttaaatttgatttgtttagtttttaaggatttttgcgtgttgatttatgagggatattggtgtggtattttttttgtttgttagtttgtttcggtaatgtttttgttagttttattttggttttataaaattagtttggaagtgtttttttttttttgttttttgtgtttttataaggttgatgttgttttttttttaaatgtttgatagaatttattaagaaaatcgtttggatttagaattttttattaggaaaggtgattgtttgtttttaattataaatttaatttaatgtatagaaagagttatttaggtttttttatttttttttgttttatttttggtaagttgtattttgaaggaatttgttttttttaggtaagttgttgaatttatttatttaaagttgttcgtaatataagtatatttagggtttgtttttagatttcggtaataaagtaaatattgtaataaagtacgttatataaattttttggttttttagtatatataaaagttatgtttaggttaggtatggtggtttatgtttgtaattttagttttttgggaggttaaggtgggcggattatttgaggttaggagtttgagaatagtttggttaatatggtgaaattttatttttattagaaatataaaaattagttgggtgtggtggtatatgtttgtagttttagttgtttgggaggttgaggtgggagaattgttcgaatttgggaggtggaggttgcggtgagttgagattatattattgtattttagattgggtgatagggcgagattttattttaaaaaaaaaagaaaaaagttatgtttatattatattatagtttattaaagtgtataagattattatgtttttttgttaaaaaatgttaataattatttgagtttttagtaagttataattttttttttggtagaaggtttgttttaatgttgatggttgttgattaggtggtggttgttgaaagttgaaggtagttgtggtagtagtttttttgttttttttttttttttttttttttttgagatagagttttgttttattgtttaggttggagtgtagtggtacgattttagtttattgtaatttttgtttttcgggtttaagtaatttttttgttttagtttttcgagtagttgggattataggtgtttgttattacgtttggttaatttttgtatttttagtagagatagggttttattttgttggttaggttggttttaaatttttgattttaggtgatttatttgttttggttttttaaagtgttgggattataggcgtgagttattgtatttggtcggtagttttttaattgaagtttttgatatgggttgatttttttttttatgaaagatttttttgtggtacgtattatgtttgatagtattttatttataatagagttttttttaaaattagagttaatttttttaattttggttacggattgattaaataagttgatgtaatattttaaattttttgttgttattttaataatgtttatagtattttcgtttggagtagattttatttttaggaattattttgtttgtttatttataagaagtaattttttatttgtttaagtttgattatgggattgtagtaatttagttttatttttaggttttatttttaattttagttttttgttatttttattatatttgtagtgattttttttgttgaagttttaaatcgtttatttatgagggttggaattaattttttttaaatttttgttaatgttgatattttaatttttttttgtgaattataagtgtttttaatggtatttagaatggggaattttttttagaaggtttttaatttattttgtttagatttattagaggaattattaattatggtagatattgttttataaaatatattttttaaataataagatttgaaaattaaatttattttttttttatgggttgtagaatgggtgttatattagtaggtatgaaaataatatttatttttatatatattttcgttagagtttttgggttataaggtgtattgttaatgagtaataatattttgaaaggattttttttttttgagtagtaggttttaatgatttttttttttttttgatggagtttcgttgtgttatttagaatggaatgcggtggtatgatttcggtttattgtaatttttgtttttcgggtttaagtgatttttgtgttttagttttttgagtagttgggattataggtatatattattatgtttggttagtttttgtattttttgtagaaatagggttttattatgttggttaggttggtttcgaatttttgattttaggtgatttatttgttttagttttttaaagtattgggattataggtatgagttattgtatcgggttttatttgttttttttttgttgttgttttttaattgagatagagtttcgttttgttgtttagattggagtgtagtagcgttattttagtttatcgtagttttcgttttttaggtttaagtgatttttttgttttagttttttgagtagttgggattgtaggtgtgtattattatgtttggttaatttttgtatttttaatagagatgaggttttattattatgttggttaggttggttttgaatttttgaatttaggtgatttgtttgttttggttttttaaaatgttgggattatagttgtgagttatcgtgtttggtttttttttgtttttttgtttttttttaaattgagatagagtttttttttgttgtttaggttggagtatagtggtacgatttcggtttattgtaattttcgttttttgggtttaagcggtttttttgttttagttttttaagtagttggaattataggcgtgtgatattatgtttgaataatttttgtatttttagtagagatgcggttttattatgttggttaggttggtttcgaatttttgattttaagtgattttttcgttttagtttttaaaagtgttgggattataggcgtgagttgtcgtattaggttttaatgggtttttaatatttagtaaattatgttgtaaatagatgtgttgttaagtagggtttgttattttatttttgaagtatagatagaatagatttggtagaatttttaagggttttaggatttttggaacggttaatgagtattggttttaatttacggttaatagttgcgttagttttttatgagagttagtttgttttttgaagttttaaagataggtattgattttttttttttagttatgaaaattttagatgatatttttttttagtagaaggtgggatatttatgttgaaattttgttgtttagtgtagttatttttattagtgttttgagttagattttttgggtaatttgttgtcgtttttttattagtatttgttgttttattttgtatttttatattatagagatggtttttttttttaaattttatgatttgatttttgttagttttaaattttttttttttagtttttttattttttttagtttttatattattgaagagagttagggttttgttttggattaggtttttgtttaagggaatgttgtggttgatttgattttttatttagattatttaaattttttttatattagtattaaggttgttttgttttttttttttttatgtgtgtattggaatcgtatttttaattttttttaataatttttttttggtatttataatttggttagttatttggtataagagattttatttttgtttgttttggttttcgatacgttttttttatttagtttaattatttttagtttttgatttaaagtgagagacgggtgatttttttttttatttgaatatttagaggttattgtagggttattaattggtttaattttaatattgttgagttttagggaatagggatgtttgagtagagggagagagagcggggaatagttagttagtggagtagttagaatatataacgtttattgaataagtttattgttttatttggatgtggttcgttatgttttaaaaataattgtaataatggtattgaagattattgattattgggcgcggtggtttatgtttgtaattttagtattttgggaggtcgaggtaggtggattatttgaggttaggagtttgagattagtttggttaatatggtgaaatttcgtttttattaaaaatattaaaattagttaggcgtggtggcgggtgtttgtagttttagttattggggaagttggggtagaagagtcgtttgaatttgggaggtggaggttgtagtgagtcgagattatattattgtattttattgtattttagtttgggtaatagagcgagattttattttaaaaaaaaaaaaaaagggtcgggcgtagtggtttacgtttgtaattttagtattttgggaggtcgaggcgggtagattatgaggttaggggattgagattattttggttaatacgatgaaatttcgtttttattaaagatacgaaaaaaatagtcgggcgtggtggtgggtgtttgtagttttagttattcgggaggttgaggtaggagaatggcgtgaattcgggaggcggagtttgtagtgagtcgagatcgcgtcgttgtattttagatagagtaagattttgttttaaaaaaaaaaaaataaagaaagaaaaaagaaaaaagagattatagattattatagtagatataataataatgaaaaagtttgaattattttaagaattattaaatttttatatagagatatagtgttaatatgttgttggaaaaatggtgttagtagatttatttgatgtagggttgttacgaatttttaatttgtaaaaagtgtagtatttgtgaagtataatgaaatgaggtgtgtttgtgttttttgttattgtaatgtcggtaggattcgtaaggaaaatattttattttttttattgtgattttatgttcgttattttttttttattagtagtttggttaggaggttattaatttagatttttttaaagaattagtattggattttttttttttggtgtttatttttttgagtttttttgttatttttattatttttttttttgtatttgttttagcgtattagttagggtttagttaggaaataaaaattatatcggtaatttgaatagtaatttgtaatataaagtgtttttaattgtaagaggtagttaattattaaagggattataaaggggtgatattgtgatataagaaagatgtatttgggttgggttcggtgtagtggtttatgtttgtaattttagtattttgggaggttgaggtaggcggattttttgagtttaggagtttgagattagtttgggtaatatggtgaaattttatgtttattaaaaatataaaaaattattttggcgtggcggtgtgtgtttgcggttttagttatttgggaggttgaggtgagaggatagtttgagttcgggaaggtagacgttgtggtgagtcgagattgtattattgtattttagtttggatgatagagggagattttgttttaaaaattaatgtatttgtttgtttgtttgtttatttatttatttatttatttatttatttatttatttagtttttgttttttaattttgtttggtatgtagtttttaaaatttttgaaatttttaaagtgatgggtgtttttttgtttgttaaggaggcgattggtggttggaggtttttggatagtttggggataagggttggttgttaggggatttagttttgtgattagaaggttagaatttgtagttttttttatttattttttgcgaggtaagaggggatgaaggttgagttgattattaatggttaaagattttatgttatgtttatgtagtgaagtttttttgaaaatttaaaaggatgaggtttgtagagttttaggttgttgaatatttgtaggtgttgggagggtagtgtattttttcgtggaagttttatgtcgttttttttatattttttttatgtattttttttagttggttgtttatttgtattttttgaaatattatttgtaataagttagtaattttaagtaaattgattttttgggttttgtgagttatttaagtaaattattgaatttgagaagggagttgtgaagattttaaatttgtagttaagttagatagaagttatgggtaatttggtgttttattatttgcgattgatttttgaagttgagggtagttttgtgagatggaatttttaatttatgggatttgtattaattttggttggtgttagaattgaattgaattgtaggatatttagttggggattgttgagtattggagaattgtttgggggtcggcgggaggaaattatatatttggtgttagagttgaagtattgagtgttgtgaatgagagtggagagatagagtttgttttgttttatgtaagaggattttaaggagtatagaaagagtaaatatgagaagtagttattttagaagaaaatataggaggaaagtttcgtgatattggagttggtaatgtttttttggatgtgatatcgaaaatataataaaagaaataaatgataaattggattttattaaaatttaaaatttttgtgtattaaggaatattattaatggcgtgaaaaggaaatttatagaatggaagaaagtatttgaaaatcgtatattcgataaaggattagtatttagaatatataaagaatttttataattaagttataaaataaaaaaaaataatttagtgaatagatatttttttatagaagatatattaatggttaagaagtataggaagagatgcgtagtgttattaattattagggaaatgaaaattaaagttataataaaatatgattttatattttttaaggtggttgttagttaaaatatggataatagtaagtgttggtaaggatatggagaaattggagtttcgtgtattgttggtgggaatgtaaaatggtgtagttgttgtggaaaagatataataattgtttaaaaaattaaatttagaatgattataatatttagtgattttatttttagatgtatattttaaagaattgatagtagggatttgaataggtgtgttatatttttgtttgtagtagtattttttttataattaaaagatgtaggtaatttaggtgtttattagcggatgaatgaatagataaaatgtggtttatttgtatagtggaatattattttgttttaaaaaggaaggagaggttaggtgtggtggtttacgtttgtaattttagcgttttggaaggtcgaggtgggtagattatttgaggttaggagtttgagattagtttggttagtatggcgaaattttgtttttgttaaaaatataaaaattagttaggtatgggggtatgtgtttgtaattttagttattagggaggttgaggtaggagaatcgtttgaattagggaggtggaggttgtagtgagtcgagattatgttattgtattttagtttgggcgatagagtaagattgttttaaaaaaaaaaaaaaaaaaaaaaaaaaaggagattttgatatatgttatagtatagatgagttttgaagatatgttaagtgatagaagttagatatgaaaagataaatattgtatgattttatttttatgaggtttttagagtagttaaatttagagagatagaaagtgggatggaggttgttagaggttgggggaagggagaatgaatgggaagttggtgtttaatggggatagaattgtagtttgggaagatgagatggatggtggtgatggttatataatagtgtgaatgtgttttatgttattaaattgtatatttgaaaatggttaaaatggtaaattttttgtgatggatattttaaggtatgtatgtaaatatatagaagtagttattattattggggttgatggaaaagaaattaagaattcggagcgttttttatattttgttacgttttacgtttaggttttgttggagagtgtgtgattgttatagaaatttgtagtttattggtaataaaaaggtttttgttagaaggtgtagaaagagtggatttgtaggattagtttattgggtagtcgagaaatttattagagggtatgggtgggtaggagttgggtgtttgagaagtttgttgaggttttattgggttagagttggggtgttggagaaatttagtatagagtaggttttattgggtatacgttattggtagttgtgtttttagaggaaaaagagattttggaattaggaagagaagttgttattttagtaaggtttggtagttttttatagtgttgttttttgtggatagagtttgatatgattgtatttggttaaggagaaagatttataaggtttcggtttagtattacggagcggggtttggtaggatgtatgtagagttaagaggtaatatatgggtaattggtatatttttttagattttttgttttttttgttgttttgttttgttttgttttgttttgttttgttttgagagagtattttgttttgttgtttaggttggagtgtagtggtatgatttaggtttattgtaatttttatttttcgggtttaagttatttttttgttttagttttttaagtagttggagatgtttattatgtttagttaatttttgtatttttagtagagatagggttttattatgttggttaggttggttttgaatttttgattttaggtgatttatttgttttggttttttaaagtgttgggattataggcgtgagttatattgtatttggtttatttttttagatttttaaagtagatttttaggtttttttttttttttttttttttttttttttattttttttttaatataagtatttatagtttttttttaagtattagttttagtttacgtattttagtatgttgtgtttttattattattttatttgaaatattgtaaaattttttttgtgattttttttttgatttatgggttatttagaagtatgttgtttaatttgtaaatagttaaggtttttttgagtattttagagttattgatttttaatttaattttattttggttagataagtatattttgtatgtttttaaaatttgagatttatggtttagaatgtgtattttggtgaatgtattgtttttatttgagaaaaaaatatgtatatatattttagattttttgagtatagagttttataattgttgattaggttaattgttagttattagtgttttttagattatttgatgtttgttttttagatgttgagagaatggtgtttgttatggtttatttgtttgtgttttttaaaatttatatgttggagtttaatttttggtgtagtggtgttgggaattggggtattagggaagtattggtttatgagggtagagttatcgtgaatgggattagttttttttgttatgtggggatatagtaggaaaaggatatttttgaagtagggagttagtttttattagatattgagtattttgattttggattttttagtttttagaattgtgagtattataatttgtttataaattatttagtttaaggtattttgttttaatattttgaatgaattgaggtggtgttaaaatttttaattatgtatttaggcgtagtggtttatatttgtaattttagtattttaggaggttaaggcgggtggattatttgaggttaggagtttgagattagtttggataatatggtgaaattttgtttttattaaaaatataaaaattagttgggcgtggtggtaggtttttgtaattttagttattcgggaggttgaggtaggagaatcgtttgaatttaggaggtggaggttgtagtgagtcgagattgtattattgtattttagtttgggtaataagagtgaaatttcgttttaaaaaaaaaaaaaaagagtttttatttatgattgtggaattgtttatttttttttttaatttttttaggttttatattatgtattttgaagtttttttggttaggtgtatatatatttatgattataatggtgtttcgatgaattgattatttaattatgatgaatgtatttttttatttcgtaataattttattttggatttaattttattgatatttatgtagtttttttagtttttttaaatatgttgtttgggatgtataagaaggttggagaggtttatggagaaatttatgatggtttgatttatagttttttaattttattatggtgcgaacgtggtatgtatatagtagaaattgtattttaagtatgtgtgaaattattgtgttttttatttttagtatagtatttaataatttatatgagatagttaatattttattataaaataggttttgtgtttgttgattttgtttaattgtaggttgaagtaagtgttttaattatgttaaggtaggttaggttaagttagaatgttcggtaagttagatgtattaagtgtatttttgagatgatatttattttttatttatgatgggtttgttaagatataattttattattatttaagtagtattagtatgtttttttttaaatagaaaattttaatttgtgtttatattgaaatagtattttttgtagatagtatatagttgagttttgttattttatttattttgatagttttcgttttttaattggaatatttaggttatttttgtttaatatagttatagatatgattgggtttagagttattattttgttttttgatatttattttttttattttgtttttttggttttttttatgttaattaagtattttttagaattttattttaatttatgttttttttttttttttttttttaagatagagttttattttgttgtttaggttggagtgtaatagtatgattttggtttattgtaatttttgttttttgggtttaagtgatttttttgttttagtttttttagtatattgggattatagacgtttgttattacggtcggttaatttttgtatttttagtaaagacggggttttattatgttggttaggttggtttcgaatttttgattttaggcgattcgtttattttggttttttaaagtgttgggattataagcgtgagttattgagttcggtttgttttgattttttaattgtatttttttgtattgttattttagtagttattttatagattttattgtatatttttagttttttatagtttatttagaattaatattgtttttttttatggaaaaaaagtgtaagaattaggtaattttatgggtttatttattattttttattttgtatgtgatggttgttagatatttattatatttatatatattgtaaattagataatataataaggaaatttttgttttaaatagttttatgtattttaaagaaattaaaagtaaaatagaattttttttatttgtttatgtatttgttatattttgtgttttttatttttttttgaagagttgagtttttatttggttttattttttatgattttggagaatttgttttacggtttttgtagtgtaggtttgtagatagttaatttttttttatttttatttatttgtaaatttttattttgttgttattttttttttttttatttttatttttatttttgagatagagttttattttgtttttttataggttatagtgtaatggtgtgattttaaaatttttgtttaattttaatttattaatttttttttttcgggtttaaacgatttttttgttttagttttttaagtagttgggattataggtatgtgttattatatttagttaatttttgtatttttagtagagatgggattttattatgatggttaggttggtttcgaatttttgattttaagtgatttgtttgttttggttttttaaaatgttgggattataggtgtgagttattgtgtttagtttgttgttatttttgaattataattttattggttatagaattttgagttgttagtttttttttttaggattttaaaatatagggttttagtgtttttggttttcgttgtttttgttaaggaattagtatttatttagttatttttttgtagattatatgttgtttttttttggatgtttttaagattttttatttaagtttgattgtttagtatttatttttgggtaaaaaagtttttagaaattagaaatttatttagttttatttttttttgttaggtgtagattttattttagtttttatttatttgagatattttatattgattttaggttgttgttattttgtttttttaaatattttgtttagagttataatgttttttgtagaattgattagatagtagttattttttgtgattaggagttttgattttttagatttgttgatgggtttataaagtttttgttcgtggtttttagttggtagtggtttttttgttttgaagttgttatgagtgtgtaaaatttataggtttaattttttttattagtatagtttagaaaagtggaatttttggtttgggtggttatggtgttttagattattggttagattagggtggtgattgttagttggtcgaatgtggggtttttagtttagtatttttggattttattttaggagttatggttgttttagggttaggggtttggttttagtttttgtttttttttttttttttttaagttgtttagtattaggttttaattagtattttttgtagatagggtgggtcggttttttattagaggggtagggttgggcgggaagtttgttgagtttttttttttgtgtagtttatagttttggggttagttttagaggggtgtagaaaggagtttttaaaggtagaaatttatttttttttttgtttttgtgtttttagggataaaggagaggtggttttagttggggggttattagtggtatgtaggaggtttatatgattattgtttgttggggtttttttttttttgtgagagagacgagagagaggagagagagtgtgagttagggtagtgtttttttttagtaacgtagatttttgtacgtgttttttaggagaaatttcgttattcgttagagttttagatttggaagaagttttgtttttttttttttttttagtgtagtgtgtgtgtgtgtgtgtgtgtgtgtgtttttatatgtattatatttttttatagaggaaataattttcgtttaagtgtaaaggttgggattggagtaggtagtatgtgggttaaaggagtagagaggaggaaacgggggcgggggtgagggtgggaataggaggtgggtagatgttacgaggtatgttttttataattagaagggttggtggagatgattagaatgttttagatagattttttattaaatttttaaaatttaattttgttttatgaagtttgaggattttgtagagtgaaagataaggaagggtttttttgtaggggggtgtgtgtgtttgtgtgtgtttgtgtgttgtgtgtttttatgtgtgtgtacgtgtggatttgtgtggtgtgtgtttgtatatgtgtgtacgtgtggatttgtgtggtgtgtgttgagtgtgtatatgtgtgtgtttgtgtgttgtgtatgtatttgtatatgtgtatatagattttattttttttttttttggtttattaagtgttagaaagaattttcgtgagtttttttattttttttaaggttgtatatggagggatttgcgtaggtatatgtgcgcgtgtatataatatatatatatatatatatatatatatatatatatatatacgagttaggggcgagtatttttgtggattgtatttaggtttggtaggaaatcgggttttgggaaattgtaggttttatttttggtagaaaattatgtttttgttgttgttcgttgaagggaatattaagtggggttggggatagtttatgttgagaagagtaaattttgtttatggtattggggatattgagtggtttttgtttcgggttttggagggtttgggagatacgtttgtagttttgggtattttttaaggttacgggcggttatatttaaggttaggtttttttttgtgtgagttgcggttagtaggaaggttgattttagaggcggttttagggtttttggaggttttgtttttgagatatgggttaaggttagagagtcgagaaggttgttgttgaggattttggttggcgtttagtttagcggttttttaggcgggttttgtgtaggggttgatgaagttagttgggaaatttgtgaaataaagtataggttttttaggtttgtttagagtttcggtattagatgaggtgtagagaagggaattgagttgttaagtgtgaataggagagaggagttttaggattatataggggtttcgatatggtaggtgtttggttagtagcggtgttgtttttattgttggacgtgggaaaatgtattgatatttgttgattagagtcggggtgagtatttgggtgattttgtagatgagataaaataagggttgtcgtgggggaggggtttttgtcgggttattttgttgaggttttgtgttattgttttgcggttgttataataaaggattataaatgaggtgatttaaaatattcgaaatcggttacgtgcggtggtttatgtttgtaattttagtattttgggaggtcgaggcggttggattacgaggttaggagatcgagattattttggttaatatggtgaaatttcgtttttattaaaaatataaaaaaaaaaaaaaaattagtcgggcgtggtggtgggtgtttgtagttttagttgtttaggaggttgaggtaggagaatggtatgaattttggaggtggaggttgtagtgagtcgagatcgcgttattgtattttagtttgggtgatagagtaagatttcgttttaaaaataaaaataaaaataaaaataaaaatattcgaaatgttttttttaaagtttttggagttagaaattttagatcgaggtgtttgaaggtttattttttttgggggtttcgagggagattgttttatgttttttttcgagttttgcggcggttagtaatttttggtatttttcggtttgtagttcggtttattttttatttggtttttattttgtgtttttttttgtgtttttgtttaaattgttttttttgttgtttttttaatttatttttagggataggtttttattttgttttttaggttggagtgtagtggcgtgattatggtttattgtagttttagttttttaggtttaagtaatttttttattttagttttttaagtagttgggatataggcgtacgttattatgtttggttaattttttaatttttttgtagagacgagggtttaggttggttttaaatttttgcgtttaggtaatgagattttgttttttaaaatattgggattagagatatgagttgttgtgtttagtttatttttgttttataaagatatttgttattggatttagggtttattttgatttaatatgtttttaaataatttaattatatttttaaagattttatgtttatataaagttatatttataggtattggggggttaggatttgtatatgttttttgggggaatataatttaatttataatgggttttatttatagaacgaacggtttttttagggtgtgcgtaggtgggtgaggggtttaggagagggatttgcgtggtaagagggtttgtgtttacgttagagattttagaaggagattggatggggtggttgtatggagtaaggggttatagttattgtttttaagtagttggtgggttgtttggtagaaagggagtatttattttgagtttttttaagatatgaagttagtattaggtatttggaaggtgttagcgagtagagtttgattttttatagaaagaggtgttttttttataatgtttatttgaggacggtggaataggttattttataaggtagtgagttttttatgtttggaagtatttaagtaggggttatgtgggagttgtttaggagtgtatagaagggattttagaggtttttgttaatattatttttgtttgttttattttacgataatttgaattttagaatgtaatgttattggggatatgtttattagaggggtttttagtattaggttttatatattatgtattatttttagggtagggaatgagagtaggttttattttttttggttgtttgtgaggattaggaggtttgttgttgaggtagttttttgtggaaatagtgttttagtttcgtaatttatttatcggagttttaatattttaatgaaatattgtgttagatgggttttgggtatgtgtgtgtagattgttataagtttatgagaatgtatatacgtatattgtatgtgtgtgtatatatgtatgtatatatgtataagaatacgaagattcgaggtaggtatagttcgtgagatagatttttttaggttgaaagattttttataagggtttttagaataaggttttagtttcggtagttttttttatttttggtgggaggatttttatagagaagaagggttaagaagtatagtttttgatgtttacggtgtattaagttttgttttaagtttgtgttttattttttatttatttagtaaatttgtcgtttttgttttgtgttagatgttgtttttagtattttataaatattgatgtatgtttgttttatgataattttgtgaagtaggtagtgttatttcgttttatagatgaggaaataggcgtagagggataaagggatttgtttaaggtttgtttttattttatacgtatatgaacgtttatttatgcggtaggcgttagtttttttttgatgtgagttaggttttgagttggttggggtttgggttttattttggttgtgttttgttgtgggtattaaggaagtttttagtagttttatttttttggtatgatttagttttagggattggatttttttaaatgtttttgtttagtttggagttttttttttagttgggggagggttgaacgattttttatttttggaggttgtcggagttttttttgtttgtatgcggtcgttgtcgggtggataggtttgtttgtgggttgaggtttttagtagttggggtggattatttttttttttaagaagttttgggagaagtagttgagggggttagcgtttttttgaggttaattttttgttttttttagcgtaggcgcgaagttatttttgtttgtgtgtttgttatagatagtggagggcggtgtaatcgtgacgtttgtttgttgtattttgcgtttttgaggacgttgatttttggtcggtgttgggcgtttgttttttagttattttgttttgatttggcgtggtaggttcgagtattgtttttttataaggaaataggtttagaggttttgagttatttgttcgggtttttttagttaataattggttgagttaggatttttatttagttttgtgattttagaagtttaagttttttttattacgttagggttaggaaaggattagaatgtttttttacgtgtcgattatttggatgatttgtgtagtttagttcgttgtagttgtttaataaaaatgtggaatgaatgggtttatatgttttattgtgtgatttagagttaatgattttggttgatttttttgtttttatttcgtggtttagtatttttttttggggtgtgtgattttggaagtagtgattttttttattttattttgaatggtgtttgcgtcgtagtaggggagtagttggggattgttagcgtttgttgttggtgggttgtgcgttagatttcgttttggatgtgtgggtgattgttagttatatgtgtgtgaagggttgtgcgtgtaggatttgtgtaaatgtgtttttttttgttgttagtttatgggaggttgttaagattttgtttttgtatattagtttatattttttttgtggtttattgttgtggttgtttttttgtgttacgtggttgtaggtatagtttttaagtggatggggatcgtgggttgaatgtgtattagatgtttttgttttttggtgggtggagatttttaatttatgtatcgtggttgtcgtatttgaaaggttttttatggtgaaggatttggatttgagtaatttttcgtagaggttttagaagtgttttttggtcgggcgcggtggtttatatttgtaattttagtattttgggaggtcgaggtgggcggattataaggttaggagatcgagattattttggttaatacggtgaaatttcgtttttattaaaaatataaaaaattagtcgggcgtggtggcgggtgtttgtagttttagttattcgggaggttgaggtaggagaatggcgtgaatttaggaggcggagtttgtagtgagtcgagatcgcgttattgtattttagtttgggcgatagagcgagatttcgttttaaaaaaaaaaaaaaaatgaagtgtttttagtttttttttttgtggtgaggttttgagtttttatttttagaagaaaatttggttggggagggtatttttagattcggatataaacgttaggagattagggttgtttttttaggtgattaattatagagatttagggaaagttacgtttggaagaggcgatattgtgttttagttttatttatttttttattttatagatattgtttggtgtttagttcgtatcgcgaggttttttaagtagttttgggtatcgtgtatttggtatggtttttagttttatttttttgttttgggagattcggtggggatttcgggttgagtttttgtggttgtggaattttggtggtttattgtggtggttgagaatagggacgtggggttggacgggttgagtgtaatttttagtggtttcgtgaattgtttgggagttttgggtagtttttttttattttgtgttttcgttttttgatggaaaaatgggggttaggggggagcgattttgaaggtattcgtgggaattaagcgaggtgataaatgtagtgtttttggtagagaattggatatagagtttatttttatgaagggggttgttttttttttttttatgtttttttttgtttttatttttttttttgtattttttttttttgtttttttttttttttttttttttttttatatgtaggtatattttatttggtgttttaattgtttttttttattgtttttttgtaagtggttttttaagtgggaatttaggtttggaaagggtgggtattttgtttggtgggttttggtaggttaggcgttgagtagttttaggagatataattttaggaaaaggtttatgtaggttggttgttatgacggattgttggtgggagaggggaaggcgtcgtggtaggggaagttttggaaatatttattagtggttttatttatgatttaggatatttgttaggttattagaatatagttgaggaagttgtcggttagacgtttagaagtattaatttggtggttgggttgtggggggatttttttggataggtagataaggtgtcggaggaaggggttgatatttatttagtgtttgttatgtattgagggtataaagggtaggatggagagttggtttacgttatttgtggaattttttaggtgtgggggtagatggggaagtaagggggtttgaagatatatgcgtttattaaatgtttttaaattttaagaagaagaataaggatatatttataggggtagggttgaaagtttgatgtatggtgttttggggtttgtttttgttgtaatagttatagtggtttttttttattttttttttttttttattttgttgtgaaaatgtttaaaatatatggttaagttgaaagtattttatagggaatatatttagttattatttagattttattattaatattaagttatatttgttttattattttatcgtttatttatttttttttcgtttggttatgaatttattttatttttattttttggtgtattttaaagtaattttaggttattttgattatttttggaattattgttagaaatttttttttttttttttttttttttttttttttttttttttgagatgggattttgttaggttatttaggttgaagtgcggtggtgtagttatagtatattgtagtttttaattttcgagtttaagtaatttttttgttttagttttttgagtagttgggatcgtaggtatttattattatatttagttttatttttaaaattttttattaattttttattttttgtatttatttaggattattttttataaagttagggtgttgtaggaggggttagaattttaagttttaattttggttttgttattaatattgtgcgatttttagtaaattattttgtttgtttaggttttgtttttatttttatgaaacgagggcgttaaattgtatgttataaataatgagggttattagttattaagtttttattttaggttaggtattttttatatgttattatgagtttttttaatttaggtattgtttttaatggatagtttagttaacggaagtttagagaggtggtgtaatttgttaaaagttttattatttagtgaatgtttttacggggtttgtatttaggagtttgatatagagtttaggttttagtatttggcgatgttttgggggtgtgagtagtttagtttattttgggtacgtgtttatttgttgttttttttgttttatgtttgtgtttgttttttttgaagtttagattgttattttttagttttaaatattaaaattggttaggtacggtggtttatgtttgtaattttagtattttgggagattaaggcgggtggattatttgaagttaggagtttaagattagtttggttaatatggtaaaattttatttttataaaaaatataaaaattagttagatatggtggcgtgtatttgtagttttagttatttaaggagaatttagttatttagttattgaggtacgagaattatttaaatttgggaggtggaggttgtagtgagtcgagatcgtattatttttttttaggttaggtaataagtgtgagattttgttttaaaaataataaataaataaaataaaataaaaattaaaattaaatgttaaaattaatttataaaataaattttggttaaagtagtttgtttattttgttttaattatgtatattgtattagattttgttaggggtttagcgtataaagatgagatttttgttttgttagataggtgggatgatggttatattttgagttagttaaggtattatttggttgtgtaataaaagttaaaatattagaggttgagtagtattcggatttacgttttagtttaagtgttagtcgttatgggggtttaggatagttcggatttagtttatttttttggtgtattttcgatatatagtttttattttttgagttgagatggttttagtttttgtcgttatgtttgtattttagttagagggaagggaagaagggagaggggaaagggtaagtgtttttttttatttttaagggtatgatttgaaagttaaatattttagtttttttttattggttagaatttagttgtatggtcgtttttgttattagggaggttgagtaatgtattttttagttgggtttttttgtgtataattaaaattttagttattatagaaaaaagggagtttagatattggggaaataattagtatttgtattatatgtattgatagttttttttgtatgaatagagttgtggtaggttttatgttagggagaaagtaagattggaaaagagtttattaaggaggtggtatttgtattgtgtttaaggggtaagaaaaacgttttttaattaggagttataaatgtttggttgaagtgttattgtttttttattttggagttggaatagacgttattagttaattatgatggttgttgggtgtattggttaatatttataattttagtattttgtgaggttgagggtgggaagattgtttggggttaggagtttgagattagtttgggtaaattgtaagattttgtttttgtaaaaaaatataaaatgtagttgagtgtggtggtatttgtagatttagttttagttattcgagaggttgagatgggaggatcgtttgggtttaggagttcgaggttgtagtgagttatgattgtattattgtattttagtttgggtgatagagtaggatttgtttttaaaaataataaaataaaattaaagttttaaaatggaaaaaaaattatgagtatataattttagatgtatttttaagatagtaaattcgggtgggcgtagtggtttatgtttgtaattttggtattttgggaggttaaggtgggtggattatttgaggttaggagtttgagattagtttggttaatagttttatttgtattataaatataaaattagttgggtatggtggtgggtatttgtgattttagttatttggaaggttgaggtaggagaattgtttgaatttaggaggcggaggttgtagtgagttaagattatattattgtattttagtttggagaaaaaaagtaaaattttgttttaaaaaaaaaaaaaaaaagtaaatttagggttaggtttgtagttatatggttatttttttttttgagtatggaggtagttttagaaatttgttttatattatattagtgggtagttgattgggttagtttgttagttgaattttatttgttatagttattttttatagtaaggggtattttagatatatttttttttttagggaagaataagtcgtagttgtttgagcgttttatttagtggtgtgtatgtttttttttaattttgtgtttagtgatgttttgtttgtagtttgaaatttgttatagtgggtgtgtttatattataggaattggtaaatattatatattaggttttattttttgttttttattagggtaggttgttttttttttgttgtttttgttttttgtttttttttttttttgagacggagtttcgttttgtcgtttaggttggcgtggagtgatgcgattttcgtttattgtaagtttcgtttttttggtttatattatttttttgtttgagtttttagaatagttgggattataggcgttcgttattatattcggttaattttttgtatttttagtagagacggggttttatcgtgttagttaggatggtttcgattttttgatttcgtaatttgtttttttcggttttttaaaatgttggtattatgttattgcgttcggtttagggtaggttgttagaaatgtattagtttgttagttttagttttgtttgttttttattttttttttttttttttttttttttgagacggggtttttttttgttgttttttaggttggagtgtagtggtgtgattttggtttattgtaatttttgttttttgggattaagtgatttttttgttttagttttttaagtagttgggattataggtgtttattattacgtttagttaaattttgtatttttagtagagatggggttttattatattggttaggttggtatcgaattttttatttaaggtgatttattcgttttggttttttaaagtgttgggattataggcgtgagttatcgtattgggtttttttcgtttttttttaatgaaaatttttttgaaagatttgtttattgatgtttgtgttaataggtattgtttgcgggatagagtttgttttttttttgaaggtttttttttgtttgggtgattatttgtatgttattttttgttgtttagaattaaagatgtagttatgtttggggtaggttgggaaaatttgtgggaattatagagtttgttgttatgttgtgttttggatatttgaagtttggtaggtaggtgggatcgagggtgggtattaggaaagtgatgtggttttataggaaggggatataggttttgagattttaggtttttaattggataaagttgttttttttttttggataaatgttttagtttatttataatcgagtggttagtttttttttttttttttttttttttttttttgagatggagtttcgttttttcgtttaggttggagtgtagtggcgttatttcggtttattgtaagtttcgttttttaggtttacgttattttttcgttttagttttcggagtagttgggattataggcgtttgttatcgcgttcggttaattttttgtatttttagtagagatagggttttatcgtgttagttaggatggtttcgattttttgatttcgtgattcgttcgtttcggttttttaaagtgttgggattataggcgtgagttatcgcgttcggttaagtggttagtttttttagttgtcgggttttgtatattttgttggttttggagattatatgtattatgtagattttatttgttttttatttttagtgttgggggaggggttaagggtttgtcgatgtgttgatatttggttatttattggttttgaatgtttatatttatttttttgaaatcgatgtttcgtatcggaggttttatgtggatttgggggtagaggtttgtattttagatggtggggtggtttttattaattaggtagattttttgttttgttttgttttttgggttttgtagttttagatgtgtgtttaagatttgtggttatatggatgggataagttatagagatttagatttcgtggtttttgtgattagagtagtcgtggttttgtttgggaatgtttttattttgttgttgaaggtgagaaatttttttgtgttggagaatagttgtgttgagaagttggtttatttggtttgtaggattgttggggtaagggaggtttgttgtcggttttttttttttttttttgattgggtgttttttgtttaggttttttgtagtaaaagaattttttaatttattttgtttttttattgagtttttattttatgaagtttattttttaattttagttgattggtttttatttttttaagaggaaggttaggggtagacgaggttgaaggaggttgatttttttgtgttttcgtagtttgagttgatgttgttgtatgtttatagggtttttttagtttttaaaaaggttttaatacgttcgttatacgtttgtggtttttttggatgttatattaatttagtaaggtttgagttagaggttgtttttgaggttgtgaaaatagaagaagggtttagaggagaatttttttatttgacgattttaggaaggttttttagaagaagtagtttttgagttgagatttgaagatagattaggtttgagttaggttagggagggtgtgaggggtttattaggtagagggaataggatagggtaggtatagaggtttggtatttggtttgtggggaagtgtgagtttttgggtatgattaaggcggggagaagtggcgtgagaggaggtagatgtggttggtaggagatcggcggtttcggttttgttgagttttattttgtatgtattaggtgatagaggttgtttaggacggtgggtagggaagtgataggttatatggttattttattaatagtcgggagtttagtttggggggatttaagattttggggaaggtacgagttaggggtttgttagagttaggagttagtgggagaaggaaatagtgttgtttatgaattataaatagatattttcgtaattttttttgacgtgatataattttaaagtgggttatttagaggtgggaaggtgatttttggttttttaggttttgggtttgttttttttttttttttttttttttttttgagatggagttttattttgttgtttaggttggagtgtagtggtgtaattttggtttattattatttttgttttttgcgtttaagtaatttttttgttttagttttttgagtagttgggattataggtatttgttattatattcggttaatttttgtatttttagtagagatggtgttttattatgttggttaggttggtttcgaatttttgattttaggtgattcgtttattttggttttttaaagtgttgggattataggtatgagttattgtgtttagtcgagtttatttttaagttttttttggtttttagtgtttttgtattagtttatttttttggttttttgtttttaagagttttttttaagattgtttttaagtggataggtttttagaattaaggagtagttttaggagtttttagttatagatattttagggggttcgtgtggtttttagtttttggtttggtttcggtagttttggttttttgtgttgttttttatatagtttggttagagttggttaggttttttggttgggtcgagttatcgtggttagtgatttatgtagggggagaaaagtgaggagggggaatagagtgcgagggggattgtgttaataataaatttattaggtttttgaggttattttataggagggataaatggtttatttaggttgatttggttgtcggttggtttttagagatatttagggtggggaagattttattatttggggaaagtaatattagattgtttggaggggtttagttagcgtatttcgcgttttttgtttgttttttacgtagagcgttttgtttttaaggcggtaggttaagagcgcgagtcgaggtttaggtgtaaagaggggtgcggtatgggggtattgtagggtacggggtgtatgtatttttatttatttttttattgagtgttagggtaatttgttaatggggtatatttggtgatataaaattttttgtcgatttatggtagtttggaacggagtggaagcgttttatttttggggaatttttatatatatttggttgtgaacgtcggtgtttttgtattggagtttttttggagtgtgttgggtagagcggagaggtttttttttttttttttttattattttgtggaggtgttaatatgtagttagagatggttagtggtagtgaggagaggggggtaggaagagattagggttgggggtttgttagtttatagttttatttttgaatatttatggtttttttgtttaggttagcgaggttgggggtagagacgggtaggggttttttaatgttgggtattttttcgtttttttatattttggatttgttttttggagaaagttttggagtatttagaagttttggggttgttggttgaggtggggagtagagtttagttgtgtttggaggttttttatttttatttagtttttagggatagttttagttgtgtaggtttaggtcgttgaggttggttttagaaatttttttataattattattggatggaaaattagttttttaaagggttttagagttagttttgtttttttttttataggtttttatagttagagtatcgggtttttgttagagatgtagaagagacgatgtttttagtttttatgtggttcggtttttattgtggatgttggtgattttagttttttttttaaaattaagagggttgatgttttatattttaggtttttagaaagagtcgttatttatttatatcgttatattttttttttatttttttgtttcggaaagagtagagtggatatgcgtttttgtagaaatttatttatagtttgattgtagatgtattttgtttttttattgagtttttgttttatgaagtttgttttgtttgtatttttttttttttttttttttttttttttttttttttttttttttttcgtttttttttttttttttttttttttgttttattttttttttttttttttttttttttttttttttttttttttttttttgttttttttattttttttttttttttttttttttttttttgaatagttaaagatagaatgaatggtataggtaggtattgagttttttgtaattggaggtgtttaagtgtagggtggatgggtatttatagggtaggtattgaggaaggatttttttgggattgtggatggtaggataggttttgtggagttttttgagcgggtgtagaagagggagggtatgtttttgttttttgtttttttcgggttgttaggtcgttatttttaatttttattttttttttttttatttgttgggttttacgggatgggtagaggtattgttagaatatggagtcgcggtttatagagggttagtagggaggagagttttttggggattacgtcgttttagttattgtggtgattttgaaaataaatgtttttttttttgtttgagtttttgttgtttttgttgacgtggaattagggtaggttggtgatttagtttttatttttgtattgtatcggtggtaagttgtttttagttttagattttatagagtagggtgttttttttagaaaaatagtagggaggttaggatattaagggttttagggatagtttgttttttttggttggtatgagttttagttaagttttttggtattttgggggtgaggaggtattagttgtgtgttttagttattggttgttttgaggttgggtcggtgttaggttggttatttttttttgttttttagtgtgattttgtagagttttcggaagggttagagggtttttttttattattggtgtttatgggatattgtgtttttattttatttttgtattttagttttagacgggtgttaggaagttggagattttagttattttacgattgtgttttgcggggttggagtaggaataggagtaggaggaacgttttggttatgggattgtgtgaagagagaaggattaggaagaaaatatgagttattatgtttgggttatattttagtagagtcgttggtggttttttaggtatttgaatttattaattataaagtttattaggtgtgtaaataaataaatgttgtttaggaggtatagttagggttttgttggagagggattattttggaggggttatattttttatttagttttttagtttttttgttttgtgtgtgtgtagtttttgattattattatttttgtttttgttatttgtttttagggttttattaggttggatgttattgtaataaaatgtagtaatagaaggtttaggtagtgttgtagtttttggtggtattattagagttagtaggtagtagggttggggaattttaagttgatttagttttaagtgtcggagcggggagttcggatgaggtgggggtggggaatcggggagttatggagtagagtatttgttgtgttgaaggttaggagtttttttgggagattatgaatttagaatattaatattttgtttaaaaagttttttgttttggagataagagtttaggtcgttgtggttaggttttgttgtaaatgttttgtataaagtaggttggggggattattgggaagtttggggaatagattggttatgtgtttttttgagtgaaattttatggttgtattgaagcggttaggtagagggtgtgatggggtgtggtagttgtatatcggtttagttaggttgaatggggaaatgtaaatttaggtggtttgaaagagatttagtggtttatagtttggtggttgtttttagtataggtgatgtaaagagagaaggggtttcgggggtttggtttaggtggaaattatgtattgtttgtgattttgggtatgtcgaggttggagtaggtttgtttggtggttggtagaacgtatatgaagaatttatgtgtgttttgaacgttttttttgtttttttgggtttatgttttattaggagtttttcgattttgttattttgtaaaggaaattgcgttttgttattgtataggatcgaataggtgtgtgtggagtttttaaagttattgttttaaggggttttatgggataatgggagagttgttgtgatgtttaagattaaagtgatggttgggcgtagtggtttacgtttgtaattttagtattttgggaggttgaggaggatggattatttgaggttaggagttcgagattattttggttaatacggtgaaattttatttttattaaaaaaataaaaattagtcgggtatggtagcgggtgtttgtaattttagttattcgggaggttgaggtaggagaattgtttcgatttgggaggcggaggttgtagtgagtcgagattacgttattatattatagttcgggcgatagagtgagattgtttaaaataataataatgttaataataaataaaataataataataaaataataaaagtaaggatttgaataaatatttgtatatttatgtttgtagtagttttatttttaattgtttaaatgtggaaggaatggatatataaagtgtgtgtatatatagtggaatattatttagtttttaaaaggaacggaattttgttattatatgtgaattttgaataatgaattttgaagattttatgttacgtaagtttgttttataaggataaatattgtatgattttatttatgtgaagttaaatttatagagaaattggaatgacggttgttagtagttaggggaaggaaggatggggagttattgtttaatgaggatagagttttagtttgggaagttggaagaagtttcggaggtggatggtgttgatgggtgtataatgtgaatgtatttaatgttattaatatggaaatttggttaaaatggtaaatttgttttttttgtttttgttttttttttttttgagacggagtttcgttttgtcgtttaggttggagtgtattggcgtgattttggtttattgtaattttcgttttttaggtttaggcgattttcgtgttttagttttttagagagttgggattataggcgtttgttattacgttcggttgatttttgtatttttagtagagatagggttttattatgttggttaggttggttttgaatttttgattttaggtgatttatttattttggttttttaaagtgttgggattataggcgtgagttatggtggttggttaaaaatggtaaattttatattatatatattttattatagtaaaaatgtattgttttattagaaaaatgatagatttttataatatgaattaaattataagttatgaaggaaaaattaagtaaaatattaaaaaattatttataagtaattatatttaaaataaaagataataaatatataatttttattattttttaggttttttgtaatatttaattattgtttgttttgttgcggttatgtttttgaggttgtatttgtatgatagaaatattatattcgtggtgattaaatatttttttttagttttatttttaatgatgttatatagataatttgaaattggtcggttgggtacgatggtttatgtttgtaattttagtattttgggaggttaaggtaggtagattatttgagtttaaaattagtttggttagtagggtgaatttttatttttagtaaaaatataaaaattagttaggagtggtggcgggtgtttgtaattcgagttatttgggaggttgaggtaggagaattatttgaatttgggaggtggagtttgtagtgagttaggattgttttattgtattttagatcgggtgatagagtgagattttgttaaaaaagaaaagaaaagaaagaaattggttaaggtaggaatattgatattataggaataggtaagcgttataaatcgggaaattgagtgttgttgtttttgttggttttaggtggtcggttgttgatcgttaattggtatattattggaggagggaggtttagattgattcgtagagagattagaggtagaaacgtattatggtttggatgttgagggtgagggaaagagaggagttaatagtggtgttcggagatttggtttgagtaattaggtggatggtagtatcgttttttaagatgaggggttgtgggaatttgaggggttgtggaaggttttgttattgacggatttagggttcggtagttttgggaggtttattttgtgttaggttacgtagagataagattatttgggttttgtttttgggaagtttttgtttatgaggatatagtttgttatttaatggggtgtttcgtttggagttttagtgttgttgggagaaagttttttattttttttcgtttttcgagttttttttgtttttttgttagttgagtttttttatggaggttgtgtttggaggggggttatggatatggatgtgtgcgttaaacgttgttttttcgtggattttttttttatttcgtttttacgttttgtaagttttattttttcggggtttgatttgtggggtttttttttagatttgtttttttttatttttagaaaggcgtgtaggggttttttatggtttttttttttgtttttatttttttttttttgggatagtgatttgttggacgggtgggttatttatagggtttgtgattgtttagatatttttgttgtatgaagttttgattttaaggtatgatgtagatgggaataaggtacgagttttttttggttgttgtaataattgtcgaaattgggtggtttatagtaaggggaatgtgtttttttatagttttggaggttagaagtttgaaattaaggtgttagtagggttagttttttttgaagattttaggggaaaatttttttttgttttttttagtttttggtggttttaggtgttttttggtttgtggttgtattatttcggtttttgtttttgtttttataaggtttttttttgtgtttttgtatttttttttttgttttttagaaggatatagtattgaatttagggtttattttattttgagatttttgtttaaattttttttgtagagatttttaaatagaattaggttatatttgaggttttaagtgggtatatttttgttttgggggggattatcggtttattgtaggtttcgttgtgtattgaagacgtaggcggtttttttggttaggtttgtagtcggttttgtttttttttgtgatcgtggaagaatgtattttgttggatgtataggtttttatagtttttttgtttttgttaaattttagtttagttttttttttgttgtcggcgtgtattttttttgtttagtgttttttttgggattgtgtgtttaggttttgaggttttagaaaaggggggtggagggtttttttattattttgtagtaatgaggttttattaaaattttggagttttagattggatttagtttttagttatgattaaaggatagttcgggatatgattaaagggttagagaaagatgatttaggttgagaaagaggaggttaaggagtaattggattgtttttgaatgtggaaaaggtaattatgatttgaagggtggtgtttagttgttttttattttttttgaggataggaaaaaaaaggaaataaatgatgtataattagagtagttggttagatacgagggtgaattttttggttgggagtatggttaagttttgatttgggttttttgaaagagttcggggaatttttttatttggaggtttttaggtttggttatgtggttttgagtgattatattgaaggggtagtggttggggttggagtcggtgggttttgagtatagttacgaaggtatgcgtattttttggttgtttttttgttattgttttttgggtttttattttggtgaggcgtgtattttggcggcgttttttagggaattaaatatgtttgttgtattgtgcgtggagatggagaatgtataattggttgattttgtgttaatttggtggaattttatgttagttttgggaaagaataattgtatgggtgtgtttatatttattaggtgttttttagaaaaatattcgagaataatgttgtggtttaggatggttgttgtgtcggattcggtatttttttaggggggttgtgttgttgggttgagttttttaggtattggatttttaaatttttaaatacggcgtggataggtggtttagtaggggttggattattcgataggtttaggtgttggagtttagataagatatattttggtttggcgtggaagatacggggtgttattaatggtagtaatggttgtatttttgaaattcgggtttttaggtcgacgagggtgtgtacgtatttgaaatgtttgtggttttgtagtttttatgtttataaatttatttggttgaaaatagtttaaaatatttaaagtatgagggagggagtgtttgttttttttaaaaaggaaggatttgattttatttatttaaaaagttatttaaatttagaatatttttcgtaagagattttttgtttttcgtttttttagaatggttggagagttttagtatttttgtatatttgggatattttagagggggtggggaggggtaagtgggtagcgagcgattttagatttaggatgagttgttaggcgtttttcggttatatatttaagggatcggagtgtagttgtagcgttgcggtttgttgtttcgggggtgggggtgttgttttatgttgtgaatttttatatggtttttgattttgggtagaggtcgagggtttaagggacggggtgatagggagagtatgtaggagtgggtttttggttttttagggcgagtggaagaagcgttttttttttttgtaggtgatagatttggggggttttttttgaggatgagagtttgttgttttttaagttttgtgtttaatttaggtttttaggtttattttagtttttcggttttgtttgttttgtggatgatatagtttaagggtagagatcgttggtttggagggaaggttaggttttaggttagggtttagaagggagggagaagtttttggggtagttttttttttgtttatttattgtttagtttttttttttatattttttttcggaaacgtttgtttttgataaggtttattttttgtttttaggaggtttttattgtggaggaagggaggcgtcgttcgtttttggtttttttgatagtcgtgttttattttcgttttgtgttttttttttcggatagtgttttttttagggtttatttaggagggtgtagcggtggttttcggggcggtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttcggggtcgttaagttgtgtagttcgtgggtcgggagtatcgaacggatatagtttaggtcgtggtagggtttagagtgggatgttttatggtttttatttaggtttggggatatttttattcgttttttagaatcgggtcgtgggggatagaaggggtttgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgtcggtgttggggttttgcgttttgcgttcgcgggagtaaatatagtaggcgaaggggaagtttatataatggtttttagcgttttggggtagggtttttgaggggcgggtttgtttttgtcgggatttggagttttcgtttttcggagaggtttttaggttgatttgggtagagttttttggtgggtcgggagggggaaaggttgtgttgaaatgagtaaattgtttaggtgttaggttaagttgggaggtgattagtttgaggtttttttcgttttatggttagaattagggttgatatttgggtgttttgagtttagttgtttatacggtttatttggggttagttttatttgagtgggggaggcggggttttttgggggattagaattttggttggacgttaagtagagtgttagtggttgttttttagggttgggtttgaggagggtgtggggcggcgaagggacgggagggggttgtgatttagtggttattggcgttgtgtagagtgtgagttggaaatatcgtagttattttgttagtttagtggtgaaagtttttttttaggttttatttttttgtatttttgttttttagagggaggggaggtttgggtttgtagagttgggagggtttgttgttttcgttttttttttttataatatttttttatttggatatttttgggtatatgtttatattggggtttttttaggtttattgtgtttcgttgagttttttgtagttttcgagtgaatgtgatttttttgtttttgtttttttgtaatttttttttgcgatcgtttttttaggggttttttttgttttaaatgtttaagtggtacgatttagtcggtttgattattttttagtaagtttttatggagagaggttttgtgttgtgtagagttttttttttgtttgcgggatcgaggtttttgtttttagtttttaatagaaagtgtcgggtttttagtgggatttttggggaagaattttcgtgttttaacgggagttttgtggcgggaggggaggttagggtttggggttgtgttcgttgtatagttgttattatttgtattatgaaagttgttagtgttttttttttgggtttttgggtgtaattttatttttgtttttatgtgtttttatttggagttgtttttgcggttgttttttaagttagttttgtgattttgtaatttagtttaagataatgggtttattgagattattttggtgtagtagttggtaattttttggttttgggggaaggttttttagtttcggggagtggggttttaatttgttggttttttgtgtttattagttttttttttgtgtgttttgaatggttttgttgggaattttggttttagagttattaggtggttcgagtcgataggcgtgagagagtgtgtgtgtgtatgagtgcgtatgtgtatgggggttgatttggggtatggaaaggtggttttttttggtgtttaaggagtttggagtatagttggagggtgtgggggtgtgtatatgggagttggataattttgggtggatagatagacgtggggaagggatgattgaaggaggtggaggagagagtgtgatttagtttagttaggggtgatgtggataggtagttttcgaattagggtagagaaaagttattattagttagtaggggagaagttagtatggaggaggcggattttgagggagagtaggaattggattgtaagaggaaggagagttttttggttagtagtagttagtagtagtgggggaggttggaatgagttggttggagagggggttggggtataaggaggggtttgtttgtgaagattatatgggttaggttgcggagggttaggtatgttcgtcgggagtgtagttggtttacgggaagtatttggagtggttgggaatgggcgtaggagtagcgtcgtgggagtataggtttttttttcggggcggtttatttggtgttttggtttttgtaaggtaggtcgaaagggtggggaggaaattgttagttttttatagcgttgggatggtggttttagggtttttgaggttagcggatgtgggtgtttgttattatgtgggttgttgaggggcggagattttaggggttattttaaagtaggacgagttttgagttacggtatttttgggggtagttttttaatcgagtagacgtttaggtttggaattttgtaatagaggttatagggttttgattagggtgttttgggaggtttagaattagtggtagtatatagggtagacggtaagtgatttggtatggggaaagaggtaggtgtttaggtcggtatagtatattcgtaaggaataggtagacgggaagtcgttcgtgggtttgtgtgtgtgttcggagttaaaattttgttaatgttttatgttttgggtatatttattttttttttggggagtatttttttttttatttttttttttttcgtttgttttttttatttagggttttttttatttttttcgttttggggatcgagggtattatggttttatgttttattatcgatgagttgtatagggatttagttttttcgttgtttaggtcgggttttttaggtttagggtttttaggaatggagagggtattagtgttttttatggatttaaatttttcgtatttcgtttttgttttttttttaagataggttttcgagttttaaggttttagggttttgtggaggtcgttacgtagtagtaaggagaatgttttgtatttggttgatgagatttttagagttttattttttatttttttattgtataaacgggtttttaggcgattgtagtattcgttattgttcgtaatagggtgataagagggatgattttttttttttttttttttttggttggtggaggtacggggttggcggacggtatgtgttttcgtgaatttaggttaaatttgttatcgtaaatacgattataattcgggtttttgtgtaataaaagtttttttaagtattagttgttggtttgttttgtttagcggtgtttgttgtaattagatttgtatatcgagaaagaatttaaaagtttttgatgtttgttgaaataatttggtttaggatttacgtgtttagattttagagttgtgtggtatttgagtttttttcgagtttttattgtcgttcgaggaggatttttagatttgtgttttggaggtagagtaggttgtgggacgggtttttgggtgggaaggattatgtggatatgtttttttgtttgagagttttaatattttcgggacgtgggagttggcgcgttggtaggatttaggtgttttttttttttttagagaaaaaggtttcgttgtttggtaataggtgtagatttgtttttaattaatgttagtaggttttttgcgtgatgaattttgttttttagttaagatttaaggtattttgtgaatattgtttttttgtagtttgagtttttgtggtgggaggtaggagttatggggagtgggggtaggttttttatacgggttttatagttattggtagtattgatttgatgttttttgagtttagagtttagggttagatagatttattgtttcgattacgagttggtttatttagaggggggcggatatagtatttaggtagtagatgtattgtgattagttttgtagcggggttgtgggttttttgggttggatgttcgggaagaggtaggtggaggtaaacgttaggatatttttgtagtgattgggtgattgtaggttggaaatgttttttgtgggttgtggttgtttaggaaggttttgaatggggttagtggatagagtttgtatttagaggggtagtgttttggaggagtgaggggtatggtagtgtagggatgtttaggtcgtttttattttgttattggaaagttgggcggtttcggtttttttagttttttcgtttgtttttttgtttgtaaagtggggttagaaatagttttttttgagggttgttgggggattttgagatgtagtttatggcgttgagtacgggttttgttttttacgggtgtggtgggtgtcgcggttggtgtggtatttgggcgggaaaagggggtatttgtaaaggataggtaggtttggatgtttaaatatgtagatttggggatgggaggttttaggtaagggtttgtgtgatgttattgtatgaatgaggtcggatagtatggttattattaattatggaaagtacggtagatattagtgttagtagcgttcgtttgggggtttttttgagttcgataggtatttaggtttttagtgtagttatgggatttttttttttttgtttggttgatattttggaggttggcgttatgttggttgtaggttttttttattgggaggttgttttggttttttttgttattatttatttttatttttattttggagtgttatagatgggtggattatatgtttatttgtagggttaagcgttgataatgaggtgagtatttgttggatgatcggattatgaggatagcgggggcgttggtagtttgcgttcggttttgtaggttggtttttttttgaaaagcggttgtggtagagtgtgtattttagggagtggtgtttgttgttttgaatatttttatttagtaggtttttgtaagggtttagttaagtgtggtgtagagttgggttggtagttggaatagttttattttgtttagtggtgagattaagggttgatgggttaaggttgcgtgttgtttgtttagttcgtggatttatttattgagtatttttatatttttatattgggttcggggtgttaggaggtggaggggggattgggtgtttggaaaaataagtttatcgagagtttgagtttttaggggttagtattaggtagttattacggtgttcggtatatagtggttatttggtttcgtcggttgttttggtggtggagagcgtgtatggtggtcgtacgtgatgggtattatttagggtaatatagatatgtagattgtgtatttgtttgtaggagttagggattttttagtttggtaatttgtgatttttgtttattcgttgggagagaggtgttgttttttgatagtttggtgtcgggagagtagaattagggttttttttttttttttttattttttattttttatatgtttaggtattaggggaggttatatttagggatgagttttggttattgggtttagggttttattgttgttattttttttttttgttagttagttaaatgttcgtttattatcgtgtcggggatggggttggtttgtttttttgaagtttttttggtgtatagtttaggttggagtttcggacgatttcgttattttttttttcgattttttttttttattttgatttattttagaaatttagttaaaaattaagtttttgtgtttttttttgataaagttattgaggaaaaatggttaaatattgtttttttttttaaagtttttttggttttttttaaatttggaggttttgagttgtttatgagattaaagggttcggaattttttggaatatagttttagaagtgggaggatttgttatttttttagttaaatagatttattagttggtttttagatatttttaggcgtttggggtatttttgggtttaggttgtttaatttggtttgtagagtttcgaggtttcgtttagattgggttagtagatagttttagagattttaagtttgttgtcgtttttaaaagttttgttaatgtttagaaatttagagggataagaagatgatttcgatgttagtcgggattataaatagtgaggttcgtttttttttttatttatgtttgtttttattgttttcgtagttgggtttttaggggattgttcgtggttatgggggaggtcgggaatgcggggtttagattttattgggtttttcgtatttttttgtttttttttgtttattttttttttcggaaatttttgaatatttttttatagtttttggtattttgttatttttggtatttttgggttaattgggaaagttattatttgtttaatatttagaaaattaaggggtttggttttaaatatattgtagtgtttttttttttatatggtatcgaattttttgtgtttttaaagttaggagtttgtgttttggatgtgggcgatggagttttgtagatatttggagcggtttttttgggagagtttttttcgtttttttatttattcgtttttttttttttgttttaagttttggttatagtttcggaggggttatttgagtgtaggttgtttttaggtgtatagttggaggggggtagttattttatatttttttgtttgttaggggtatttttagggatttaggttttgagggatagcggaagggtggggtggggagtaggtcgttgtttcgtgttatttgggtgttatgtagattttgaatgggtagtttttgggagttggttttttttttttattttttttatagtgttgtttttttgaggggttggagttttttggagttttttgtagtttgtggtaggtttttttgattttgtgtttggtttcgtagtttttaatttatagttagtggtatgaagaatatttttggttgtttttatttgtggtttttgtaggtagtagttttttggggtagggtttgggggttttggtatttttttgtgggattttttgggtatgagggagggagttatttgggttatagatagattttttttttgtatttaggaggtttaggatggatttgttttatttttttttttggtgggaagagagtatttttggttatggggaatgtggtttggatagagttatttagtttttttttttttttaggtagggttttgaaagatggagatggttttgtttttgttaggttaatagttagtagtttggtggatttttatgtagtttaggtaggatttttttttgtttttattttttattttatgtgtaggaagttggttttaagtagggatttttggtttcgttttttacgtgggtgggtagtttttttgcgaggggtaggttaggtttttgttttatgttttttagagatcgatgttatttatagtaagagtatataagtttttttggttttaaattaggtttggaggggtggtttttttttttgttttttgttttttgttttttattaaaggttagggaatggagtgttttgtatgtttgttggggttgggtttttttttttggtttaaaatgaagggttggaatttttggtgtagattgtacggtgagaggtgttttttgggatttattcgaggagtattattgttgaatgttttgttaggttaggagtatcgttgggggtgggagaggtagttggtttatttgtttatttaatagttatttatgggtattttaagggttagttttgttttaggtattgggggtttaggtatgggtttaggagaaggggtagaacgggagggttttttggaggaaggttttttaattagagatcggggtaggagtttgttaggtaggtgatgttggttagttttttttgttattttttttttttttttttttttttttttttttttttttttttgagatagagtttcgtttttgttgtttaggttgtagtgtagtggcgtgatttcggtttattgtatttttcgttttttgggtttaagcgatttttttgttttagttttttgagtagttgagattttaggtacgtattattacgtttagttaattttttgtatttttagtagagataaggttttattttgttggttaggttggttttaaattttttattttaggtgattcgtttattttggttttttaaagtgttgggattataggtgtgagttattgcgttcggtttttttttgttatttttgtagatttatagtgtgtgtggaagattgtatgtttgtgtttggtatagttgttttcggtatttaggtgggaggtgggggagagggttgttggtgttagtataggttatggtatgagataggttttcgtagttaagcggggtgtatcgtagtattggaggggttttgttgcgtacgagatttaggttttgtatttgtttttttttttaggaggtttggagggttgggagggattagggtggtgaaataatttaggtgggagagaggtattgttggagaggtagagggagttgtaggtttgtagtagcgagttttaaattttgggtttttattagaaaattttagaaagggttgttttgtttttttttttaaattataaaagaaatttttggtcgtttgggttttttggggtcgggtgggggaggagattttttattcgtatttttgtaggtttagtattgtgtagagggaggagggtggaggtaaaggcgagggaggagggtggaagtaaaggcggggtttttttttagtttcgttgttttgtttggttgttgtttttagatttttatttttggttcggaaatatggaattttgggatagttggggtagggggtatagaacggagattttggtgagggaggaattttttttttagttttggttgtggttatagtaaggttaggttgggaggattttatttaaatatttatattttttttaatatttaaatgatgaagtaggtttttgtatatagttgttttggagttagttgttgtttgttttatttttttttttttttttttttttttttttttttttttttttttttttttttttttttttttttttttttttttttgtattttttgtttttgatttaagtttaggtttttttagttgttttttttttatttataggtattttttgtgattgagtttttttttgttattttttataattattttttttaattgagtattttttaggtgttaggttttgggttggtattttgtatataaggtgttttttaatttttacgagagtttaataaggtagattgggttgttgaggttttagcgttggaaggtcggttcgggtttttttagttcgtatttgtatttatttattatttttttattgtggagatttgttttttggtttttggttgagtacgatggaaatttttgtttattagtttttggagagtggggatggttgagggtttcgattttggggtttgacgggggttgtttttgttttattttagtttggttgtttttttatttaatgattgagtttgtaaaattagaataatagtgttatttggttggtattttgggtggttgggaggcgtgggagagggtgtacggaggggttgagcgaggtgttagtatcgtggggattttcgagggtagtttttttaggtttagggcggagtgtaggtagagggcgcgatggtttagcgtgtcggtttatatttggttttgtttttgtttatacggtaatgtgggggagttattagttttttagtgttttagttttttatttgtgtaatggggataagagtaaattattgtttttaggtatggtaagtatttatatatattgattattgtagaatgaatatagtgagttttttttaggtttttattatatgttaggtagggtgttaggttttagtggagaggggataatgatgggtaagttggtttttgtttttaagggttgtcgagtagggaggaaggcggcggttgttttgattgtgattcggagtggggtgattcgtaaagaggttggcgggaggttggttgggggttggttgggggttgtttttttttttgtttgtgtttcgtggtagggtattaaattggttttttttatggattttcgaggttttgattgtgggatttcgggtaggttttgggattttgtgattttgttttcgtttgttatttaggtttttgtttttagtagtgtttagtatacggcgatttttgtatgttttttagtgtgtgattgattttggagttgagatttggtagttgaggttggatattgtttttggataattttcggggaggtgggggtagggtggggttgtgagttggtaatttcgagtttttagtagttttcgaatggaggttttttttttgtaggattttcggggaggaaggaggggatgggggagatgaggtttgtgagtttttaggagggtagaggtttatatttgtagcgttttagaaatatttcggggtgtttaggtttatttagtttttttgagttagaattattaagagttggggattagtagtttattttttagtaagatttagaaatgatttttttgaatagttcgagttaagaatgatatatttggaattagaatattagaattatagaggaatcgagagaacgggtttaaaatgtgtagggattttagttatatggcgttatatggaggaaagtatttaatattattattgtatgaatttgtttaaatatatatatatatatatatatatatatatatatatatatatatattttttagtaaagagtggaaagatatttgttagaatattgatggaagttatttgggttgtgggtttatagattttttttttttgtttttgtgtattttgtaaattttcggttttgtgtttaaattttttttatagttaggaataaagtaatagatgttattttttaaagtttatgggttcgtgttcgtaattttaatattttgggaggttgaggtaggaggattttttaagtttaggagtttgagattagtttgggtaatatagggagatttttatttttttttttttttttttttgatagagttttattgtgttttaggttgaagtggcggtggtacgtttttggtttattgtaatttttgttttttaggtttaggtgatttttatgttttagttttttgagtagttggattatagatatttatatttgtaggatttgagaattttataagaggaaagtttttattcggaggttgttggggatttggagttgttagtttatatattttttagtagagatagggttttattatgttgattaggttggttttaaatttttgtttttaagtgatttatttatttcggttttttaaggttttaggattataggcgtgagttattgcgttcggttatgggagatttttttttaaaataagaataaaaataaaaataaataaaagtttattgttaaaaagaaaaatatattatttaatttaatttttttttaggattgagagatgaggaagtagaggtcggaaagtgttatattttttggtcgttggtagttaggggatttgaggtttgggttggttttttcgtgttttaggtttggggtgttaggtggagtttttgttttgtttaaaggtttaggtgtttttgttagtattgtttgtttttgtatttttggttataaggaatgtgggttaaaggtagggtttttgatttttgtttaggagggtgaagtgggttggttttttttgtttttgttttaaggtttttgcggttgtgtttttggaaattgttggttcgagttagtgtgcggagttgggatagattttatcgtggttttcgtggggttattttatgttcgggttggaagggatttttcggtttagttttttttgttttttattaggaaattgagattagagaggttatttgtttggttcggggtggggtgtagatggcgtttgtgatttttgtatgttacgtgtagatagttttttagttgtgggttttttacgtaagtagttatgttggggataatttggttgaaatttgcgatttaatgaagagaagaatgattttttttgtagttttgtgttttataggtttttttttgtttttattttttttgtagaggggttttatgttggtgggtgggtttttgttgttgtaatgggtttaggtagtttttgggtagtggaggtttggttgtttttttgtttaatgttttttgtagtttacgttgttcgggaagggcggggaagtatttagttattggggattttataagatgggtatttgggagatgttgattggtaggttaggttttcgtggtttataggtaggttagaggttatagtgttgagttgggttgagttggtagtttagggtagtgggggtgggggtattttgtttagttatgggtttttttggtataagggtttggagtttattgtaaataatttttttagttttttttttttttataggttattagtagaattgaggggttttttgttgatgaggtgtggtttgggaggggttagttgtttgtttatttgatttttgcggataggtgattataggttttttgttttagggggttgggggaaagatcggggaggtttttttggtttttttatttggaaggaaaatacgggtataggggagatattttatagggatatattttagttagtattttttggttgtgttgggggtatagtgtttgttttgtttataagaggggttagttttttttaggatttaattttagtttttagtgtagggtagatgagtatttagaggtttagaggatttatattacgagagagaagttgtgattatataggtattgaaggttaagtagaagagtgggatatacgggtgatttgaaagttttagggttagtgtggttagttttagatagttggggagttttgggtattaggtttagtaggggaggagggttttcgtgatagtttgttggggttgttgtaataaagttttacgaattttgggggttgaagatggttttagaggttagaagtttaaaattaaggtgtcgattaggttgattttttggggtttttgcgggaggtttcggtttaggttttttttttagtttttggtggttttcgggtgtttttgggtatgtagatgcgttacgttattttttgtttcgtttttatatggttttttttttgtgtttttgtgtttcgtaaggatgtttgttattgtatttagagtttattttaaatttaggatattttttttttgagattttttattgtatttgtaaagattttattttaatttttgttatatttataggttcgagggttagggttttggtatgttttttgggggttattatttagtttattgcggtagttgattttaggggaagtagaatgttttaagtttggggtgagcggagggaacgttgttgggtggggagtgggagattaggttcggagatatcgcggattttttttgtttgatgagggcgtgatgaggtttttattttaggttttttgaatggcggttgtttttgaggagatttttttttttggatttgtttttttagaaatttttatttaggtttaggttttaaggtggatggtaagaggcggttgtttttgttatatttgatgggtgagtgtgtgaacggggttgggagtaggatatttgttatttttgtggatagattttagaggtttatgaatttgttgttggggaaggtgtttgatttagtttgattttttatttttattttttttttttcgtttttttttattagttttgtttttagagttttatttttttaaaggtaggcgtcgttttttggattttttagtagttattttttattttagattttttttttgtaggtttttttggttttagcgtttatttttttttgggtttttgtttttttatcgtgaggtttttgggtagaagtgtggggttttttcgttgtgtttggttttcgcggtatattaggggtttttttaggggttcgttttgttcgttaggtttttagggagttttttaagtttttagatgggtttgatggagttttttaatgcgttgttttagagtaggaggggtttcggttgagttcgagagtttttttagttatattttgggttgtttggggtagttaggtagttcgttttttggaggtgttgtttttttttggttattttttttggaattttttgcgtttagttgcggttttttttatatagtatatttattatttttttttatttgtgatttttttttgttaatttttttatgtttttgagaatggagattaggttttttttattttggagtttagtagaatttaaattaggtagattcgtgtaggtttacgtgggggttttgtggttattgtggttttgtcgttatttttagtttagtttggcgcgttttggattatgttatttagtgtcggttttttaaattttttttttggttttgtaggtttgggaagtagttggtttttgggtgtagttgtgatcggagtttgaattttgttttttggggttatcgttttttgtaattaggttgtagtttatattggttcgggtagaggttatcggttgttcgttttggggttataatatagagagtttcgtgattaatggaggttttatttgggttaagtggtttttggtgttaggcgtttttttttttttttttttttttttgtattttttaagtgtttgtaatattttttttaatggataatgagacgaggagggagggaggggtggtttttttgtttaggtagattaggaatggttatcgtttgtgtgtgtagtgataggtttgggaatagataagggagagtttgttcgggaggttggatttttatatcgatgttgtttgtgtttggtagttttgtttcgggttttagaatagatattgattaatacgttttttagggtttttaggttcgggttttggttttcggtagagttttttatttatgggaagaagtatcgagtagttttgttggtttttcgtagggagttgggatgtatttttaagagtagtatgcgtgaagttcggggtttgggtaaaggagtgtttggggaagagtttgttgttgttggagggtcggaagtagaggggaaggaggggtacgcggtaggttgaggaggtggttggcgattttgtggtggggacgagggggttatgagtagattaggagttagtattacgtttttttgtttttagaatcgaggacggagagttgttagagaggttttggcggggtgtttggggttatttaaagggcgtgggtggattaaagttgaggaaagttttattttgggggatttcgtatttaatttttgaggtttttagagttgtagtttgtggtttttcgaagttaattattttttagggtttcgtttttgtttttagcgatagttatttattagggagtttttgatttaaggagatttgaaaggttatttggttttttttttatttttaggtaggttatatttagatttttttatatagattcgttttatttttttgttgttttttattagggacggagggtgggcggtttttttatttaggttttggcggttttattttagttaggaaattttttttttttatttgttttatatttttttttttgcggttttcgtttatttttttttaatttgtttttagtggagtagttagtagttggtttagaattcgggggtggggggagcgttagattagtgtagtatatttgagagtgtgttagaggtgtttttatttttatagttgatttagtaaagaaaagaggaagtttagtaatttagcgttattttaaagttcgtttggaatgattttgtggttgtcggaattaggggtacgcggtagatgacgggagtaggtatagagaggttttcgtttcggattagtcgttgttgtttttttggaggttgggttgttttttaagaagaggatttaaggttttgtgagcggtggttttttttggagtttttattgtggttttggttttgttttgcgtaaagagagatggtttgaagtagaagttgttacgtggttgttttaggtaggcgttcgtagttttagttattcgggaggcggaggtaggagaatggtatgaattcgggaggcggagtttgtagtgagtagagatggtattattgtatcgtagtttgggcgatagagtaagatttcgttttaaaaaaaaaaaaaaaaaaaaggagtagagaaattttttttagaaggtttgtagttattttttttttatgttttagaggtaaaaaaaaaaaaaattgtatatttcgttttttttttttttttttgagacggagtttcgttttgtcgtttaggttggagtgtagtggcgcgatttcggttcgttgtaagtttcgtttttcgggtttacgttatttttttgttttagtttttcgagtagttgggattataggcgttcgttattacgttcggttaattttttgtgtttttagtagagacggggttttattgtgttagttaggatggtttcgattttttgatttcgtgatttgttcgtttttgttttttaaagtgttgggattataggcgtgagtcgtcgcgttcggttatacgtttttgtttttgaataggtggttttttgattttgggtgtggttattttaagattttgttttggtggggtataattttggttttaggtagggcgatcgtataatttattgttttttgggggatacgttagtgaaagggatttttgaatgattacggtgggataatagatgtgagttgggtttgttttaggaaggttggatgtatgggttttttgagttagaggagataatagtagaaagttttgcggttgatgggatcgagtaggagaagggtcggcggaggttggggtaataacgtatttgtttattgtgaagggtttgtgtgagttgatggttgatgagagggtagtggggcgaggttgttttttgttaggttagattagttttaggatatttatattttttttttagaatcggtgatttagtggttagaaggggttttagaattgacgggatattgagggagtcgaatggaatggttggagtggttatagtaggttttaggttttttttcgttttttttttgtgttttgtttttggggtttatattttggggttgttgtaatagagtgttataatttgggggtttataaatatagttttcggcggtttttggagatttttggcgttttttggtttgtagacgtattattattatttttgatttttggtttttgtttttacgtggttttttttttttgtttgtgtgtttttttttttttttgttttttataaagatgtttattattggatttagggtttattaaatttagaatgattttattttgagatttttattttaattatatttgtaaagattcgttttttaaatgtgattatgttcgtaggttttaggagttaggatttaagatatatcgttttgggggatattgttgaatttattatatttaataaatttagagttggtgttaatgttttttgcggatattatagtagattttggaggttttttgtaaaggaattcgtaggatttttttttttttttggagggatgagattgtagttgggttggggaaagttgttggtttaagttggggttggtttagttggtgttggtttgttaggttgttagagagttttatttagggagaaattaatattataaagttgggggataagagaaggtttggaattttaagggttggttgttgaggttagttgtttatttttttgtgttttattttatagggatttaggtttgttagtgtttcgtttttggaaggaatgttgtgggttgttgtgttttataggtagggtggagggtttttttgtagttagcgagttgttttttttgtagcgtgtagagggaaggaggaggtttgtttattttttttggttttagtcgaaaatttaattataggttttggtattaggtagatttgtttatttttatattattattgtagagtgagttaggttttttgggtggggttgtgatgagtaggaaggattttcggagtgtttgggattttttgggtttagggttgttagaggtagagagaaagaagtttttttttaatatttgagtaaagatagttattagaatttattagagtggttttttgtggtttttttttgggtgttgatttttttggtgtatttgaagtttttagggatattattgacgttttttgtatttttatttaggggttagtggaaatggttttttttttttttgtttagaggtattgtggatgatgattttaggttttagattttagttattgggttacgtgtgtagataagtttgggtagttagtaatttttggttattaagttggttttttgcggattgggtcggtattggaggcgggttttagttgttagtattgtggtttagttaggtttggttttgggaaggtagagggggaggggattgggaaagggattgagttgggggtggggtggtattttggttttttttttttagatttttggtaggtttgaattatttggttgcggttttttaaggagggagcgtttttttcgttttgatgtggattttgttttttgtttacgttgtttttgtttttaaataaatgtggttttttgtggggagtttgggggtcgttttttattgatattgttgttttttggtttttttttgtaggtttcgtttagttttattgcgtttatttttaagtttttttttttggacggttttgttttttgagaatatatttttttttattattttaattgtgtttttttttttattcggagtttgttttatttgttttaggagttattttttttttttattaagtagtttaggttaattttggagggttaatttgtgtttttttagaagtaggttttgagatagggattttagtgggaggggatattaggggatgtttgagtgtgggaatgggttaggtagggaatttagttaataaagggtgttttattagtttattgtgattataggtggttgtttagtttttatatcgggtagtatggggagattgtagatcgtgtttttagttttgttttatttggggttgggtaagggagttggggtttttatattttagtttttggttaaggattgtattgtttattttttttagtttttcgagggtttgggtattaggaaaggttttgggtggagatacggaaataggttatgtgaagttagtgggcgtgattggtagtagtaaggttaggatagttttggttattagtaaggtgattatatattttagtatgtatagtttttatagatatatatttaggagatggtaattatattagtaatagttatttttgtcgcgtgttatgtttgtatttagggaattttattttttatttatttatttatttttatttgagatggagttgcgtttttgttgtttaggatagagtgtaatggtataatttcggtttattataattttcgttttttgggtttaagttattttgttttagtttttcgagtagttgggattataggtatgtattattacgtttgattatttttgtatttttagtagagatggggtttttttattttggttaggttggtttcgaatttttgattttaggtgatttatttattttagttttttaaagtgttaggattataggtatgagttatcgcgtttggttttaggggtattttattattttattattttttatagtaggtgatattgaggatattgaggtttagagtagattgtggttatgttatttttttgtttggtttttttgtttttagttttgaaataaagagtacggtttttgtgtaggtttatacgttttgtttttagttttggagtagtttttaagttttttgaaggtatattaggtttttgggtttcgttttttaagttttggataaataggaggtgaaggagtttttgtaattggattttattttgttagcgttaaggttttgtttgattatttattttattttatatagattagggatttgtgttaaggtttagtgttataggagagtgaagataaggaggtgtttatggcgtatatgttgttggatttattttgtagattttaagggttatggggagttatttgttaggtgaggttttttcgtggtttttttttgtaggtttagggtagtatatagggaggtgtttttttattttttggtattatttgttcggtttttttgagttttgattttggtttttagatagttagtgtttttttagggatagaatttgttttgttgttgtttagaggagatttagtttgattagggttagcgtttttggaatttgagtttggaattttattttgttttgggtagaggttacgttgtttttttttacgagagttgagttgcgtatgagattattttgattttgggttttattatttttttgtatgatatttgttttaggttggagtagggttttgtggttcgtttggtgttttttttttagattgaggtttgatatgtatattaggaagtgtttgatttggttttaggagttgggagcggtttgttaggtagtttgtggttagagtaggggttttaataatggttttttgtgcggtatatttttttttaaataggtttaggtttaggttgtttttgtttcgatttcgttatgggtttggaggggaaagtttgtatttggagggtggtttattgtggtttttttttgtgtagtagttgagatcgtaggtgtttgagaataggagaagttttgtgtttattttgggttgtgagatgtttttttagaggtggggatggggatgggttagtatgtagttatttatattttttagtttgttggtattaaggtttgtgtatgtgtgtgtttttttttttttaattttgtttttttaatatggagttttgttatttgtttaggttggtttcggatttttggtttaagcgattttttagttttaggtttttaaagtgttgggattataggtgtgagttattatgtttagttagtattaaggtgtgttttttaagagtaatattggtcgggtgtagtggtttacgtttgtaatcgtagtattttgggaggtcgaggtaggcggattatgaggttagtagattgagattattttggttaatacggtgaaatcgtgtttttattaaaaatataaaaaaattagttagacgtggtggtcgggtatttgtagttttagttattcgggaggttgaggtaggagaatggcgtgaatttgggaggtggagtttgcggtgagtcgagattgcgttattgtattttagtttgggcgatagagcgagattgttttaaaaaaaaaaaaaaaaaagaataatatcgatggttttattttttgaatatgttaagtgatttttatgtagtataagtattttagaaggtaggaaaatgtaatgaataatatttatcgttatttattttatttagagatcgttattttttgttcgggtgtgagtgtgtgtgtgcgtgtaaattgtatatgtgtgtatgaaatggaattaggatttttgtatatattttgtgttttgttatttttatttaatattttcggtattttttatttttaaaaatgtgattttaatgatggtgtaggtttttgatatatgggtttagaaaatttgcggaaattcggattgtttttaggttttgttagtttaatgttgatgtaaatgttttcgtacgtaaatttttttgtatttttgattatttttttgggataaatttttagaagtgggttaaagtatatgaacggtttttaggtttttggagtaagttgagatcggtggggattggagaagggatttagggaggtttttgggagtttgcgagattggagtttggttttaggggatttgaatttatagatgaaggagatggttggtaaaggtgggaattttttgttttatgggtgggggggtgatattgttttattttttagtgatagtatggggatttttttaatatgatttggtttcgtatttttttgatattgtgtacggtttatagttgtgatgtttagttgggagttttttttgtgttttttagttgtattaattttttgtagatagaggaggaagttgttcggtgtttttttttgttgcgtgggttttttgaatttgtttagttgggtttgtggatttgtgtagttacgtacggggttttaaaatttgtaaaatgataagtttacgaatattttcgtttttgtgggtgaatgtggatattttttggttgcgtttttttttatagggaagatggagacgtgtaaagtgataaggatttgttatttttgggtaggttatgtcggttttattgtgaggatggtggtagggggttttttaggaggtttgtatattgggaagagaggggcgatcgtgtgtgattgtaggatttagggcgtagttttaggattttgatgggggaggagatgttggggagttttgttttgttagtttggtgatagatattttttaatgtttttcggttgggtataatttataatgtttttcgtggggaggtaattgtttatgaggtatttttggtagggatgattttgttttattgttatatattttagtaatgaaataagaatttagagtgatgtgattttttcgatgatttttttaattatttggggtttttgtgcgattttaagaagggggaaggaggtagttttcgtttttttgggtttttgatgtggtagttttggaatggttacgtgttcgttggtttatagtgggttatttgtcgaatgtggttgtggtgggattggggttgggttggagagtgggtgattatattagttagttttattttgggttattgtgtagttaggggttttatttttttaggggtttcgttgtgagtgttttggggttgttggaataaattattggaaattaagtggtttaataaagattgattcgtttatggttttggaggttataagtttgatattaaggtattggtaggattatatttttttcgatagttcgaggggaggatttttttttgttttttttagtttgcgttggtttaggcgttttttggttttggtagtatttgtagtttttgtttttattacgtagttttttttatcgtgtttttttgtgttttaagtttttttttgttttttttttataaggatatcgagtattggatttagagtttattttaaatttaggatagttttatttcgggatttttaattatatttgtaaagattttttttttaaataaggttatattcgtgggtttttggggttaggtattagatatgtttttttgggggttattagttaattttttatagaattttagacgaaagtgaatttttataggttgaaatgggggtgaaggtttagtgcgttttttttttttgggagtttttttagggtttgtgtttattttgtgattttgtgatttagttttttttttgagatgaagttttgttttgtcgtttaggttggagtattgtggtacgatttgggtttattgtaatttttgtttttcgaatttaagtgatttttttgttttagttttttaagtagttgggattataggcgtttatttttatgtttagttaattttttgtgtttttagtagagatagggttttattatgttggttaggttggtttcgaatttttgattttaggtgattcgtttgttttgggtttgttttggttttttaaagtgttgggattataggtatgagttattacgtttggtatttagtaggttttggttgttttttttttttgagatagagttttattttgttatttaggttggagtgtagtggtgtgattatggtttattgtagttttgattttttggttttaagtgatttttttattttagtttttcgagtagttgggattataggtatatgttattatttttggttaatttttgtattgtttagtggagtcggggttttgttatgttgtttaggtttgttttgaatttttgggtttaagcgatttgtttattttggttttttaaagtgttggggttataggcgtgagttattacgtttggtttagtaggttttttagaagcgtttgaggtttggtgaaggtatggtgttatggagtagagaatatttaattttgttttcggggagtcggaatatatttttcgtagttaattttaatagttatgacgtggttaggatgatatggggagggggtggtgtggattgtgtgggaggttagtttttcgggaagggggttggagtgggtttggttttgaggaggatttttaagaggaggaggaggcggtggtatgttcgtttggggggatggcgtgagttagggtgggtatttttttatttaggtgttatttttttgatattttagtcgggatatggtttttttggggaagatggatatttttagagtggggtattttttggggaagatggatattttcggaatggggcgttttttgtttttattgtttttttagtatatagttgtatttttttgtagttttggaggttgtgagattttttggttgttatttagaataaattcgtttttgagtagcgtcgttttgatggtggggtggtttttgcgggtggaatagtttttgttgttttagagtttattgagagttagtgggtatgggagtggtgttggatcgaaatatttagagggattatagagttaggtagtaagtatagaggttagttagtggggagggagggatttatttatgaaaagatattaagtattgaaagagaggagaggatggttggggatcggtatatatgtgtattttgcgtagatggttaaggtggtgaggcgttagttacgtagataattggaggaaggaggagtgttttaggggaggggttagtttcggttttagaatgattcgtttgtgtacgtgggtttggttggaataaattattgtattcgtatcgtagatttaatcgtaagtttatattagggtagtttttgttttggtgtagtgttttcgattatgagttggttatggtgggggtgattttaaggggatttttaaggagggggtttatcggattttttagggaaggttatttgtttttttgggttggatttgggataaggtttttttttgtttagtttttgttttttaatttgatcgtacggaaggatgttgaggatatttggaagtcggtttttgttttatagtatttataggatagaggtatattatgtggggatagtttggatagtgtttaggaggtagggagtagattagaggatcgcgggaggttttgggaatcgtacgaggatttaggtattgagttttgtattttttggtattagttcgatgtatagtttggttttgtgtttatttcgtattttattttttttatttgtacgggggcggtaataatattttttatagtttaggtttaagcgggtgtagatgtgatgagtttggtaagtttattttattatatttagttttgggtattgaattttggattttttggttggtagaagtggatatttaatttttttttggggttttggggtttttgtagaattagaatatagttagtagtttgtatgtagggtgtagagggatagagggatattatgtcgggagtttatatttggtatatttttgattttggggtttagtgttttgttgttttgcggttacgtgattagttagaggttatggttggatttataggcgaatatagtttgtggatttgattttgtttggttttgcggtgttttattttatttttagttttagtttgtggagatagagtttcgttttgttagttaggttgagtgtagtgatacgattttagttttgtaatttttgtttttcgggtttaagcgatttttttgttttagttttttgagtagttgggattataggcgagtgttattatgtttagttaattttttatttttagtaaagatggggttttattatattagttaggttgtttagtgttttaaaaagggtttgttttgttttgtgttagtatttaaagattaggagatattatataaagatttagatttttatttttttgagaagtgaatagttttggttacgtcgggtttatattttttagggtagtgacggagttgagatagggtttgtgataattgagagttttttggagtttatacggttttttgtttagtttttggtggaggttgagtttagtgatttaggatttcgtttgtgtttattaagaaggagaggtgtttgtggtttagagagggcgtttataggagtgttttgtttaggaagttggtagttgaggcggttagggttagggggttgggttttttttttttttttttagtgtttgagtgtatttggaggaagagagacgggtgaggggaaggtattgaaattggttttggagcgttattattgggggttggggattagttgttatttttttttttgtgggtaggggaggtagtggtgggattttatgagattcggattttgtggtttggtgaggtagggagcggttggggagatattgtgggtttttataggggtgcgttgtgggtttggtttggggaaggagttggtgaatgtgtttgttatgtgggtttttttttgttttggttttgataattaggagcggttggtttttatttggagtgcggttgtggggattgtggaggtggtagttttttaggtattatttttattgttttcgagggagtagattttggtggagaggtaggatggttgtagggcgggagttggtggttggtattattgtacgggtttgtagtagtggatgggaagatgtaggagaggttgatgattgagaaagttggtttttgtggattaagttgggggagtcggataattaagtggttagaattttgggttttggtattagtttgatgtatagtttggttttgtgtttatttcgtgttttattttttttatttgtattgggggtattggtattttttatattttagggttaagcggttgtagatgtgatgagttcggtaggttcggcgtttcgtcggtattgaaagttttagtgttcgtttttagtgttattgatggggttttgtttttgttgcggttttgattggttatagttgcggttatttattattggaggtatgtttttcgttgtggttgatggtagaggtgtgtttgttggtggtgttttagtgtgtgttttggttggaggtgaggagggataaaaatagtcgcgataagaaggaaattaaggtcgggtacggtggcgtacgtttgtaattttagtattttgggaggtcgaggcgggtggatcgtttgaggttaggagttcgagattagattgattaatatggtgaaattttatttttattaaaaatataaaaattagttaggtatggtggttcgtgtttataattttagttattggggaggttgaggtaggagaatcgtttgaattcgggaggtgtcgttgtattttagttagggtaatagagtaagattttattttaaaaaaaaaaagaaggaaataaaagttttttttggaattagaacgtttttatgtagacgtagttggagggggaggttgtgtggtttgcgtcgtggttatggtaagatacgacgggtagtatttttttattttagtttgtatttttgttttagaatttatgatggtttttttaggatggggttgtttttttcgtttgttgagatatgaaggacgggaagagattttcggtttttatcgtcgtatcgtttgtttttttttgttgttttttagtaggaaatatgtcggagtgttttttagttatttatttattaattgtattttttttttttattttttagttttgaaaagattttttgaggtcgaggaggtcgagatatttaattttattttatttcggagggtttagatttttttatttcgagttattgtggttagttttatttagaaattttaggatttgggcgtgaagaatttagaattttcggttcgttatgtggattttttaagttaacgtttttttaaggcgtttttgcggagggtggagttttcgggttttaaggcggtcgagtcggtgtttcggcgtattgagttgtttattgatatttcgtttaagtaggtggagaacgtcggggttatcggttcgtttcggttcgggtttaagagggtcgaggtgttgggttataagacgttagaatcggtttttcggaggacggagattattatcgttaaattttaggagttagtttatcggaggatggagttttttgtttttaaggttttcgaggtgtttattgtttttgttatcgacgtagtttttaagagggtggagatttagatgtttaagtttgttgaggcgtttatcgtttttagtttagtttagattttggagaatttagagtttgtttttgtgttttagttgtagagtaggttggagtttaagttttagttttttgtggttgaggttatatttcggagttaggagggtgagtcgtagagcgttaggttttggatgttgtggtaatggggggtttggttgttggttttgttatagaattttggaggaagaagttggatatggggtggagggtgttattttggagatttagaaagatcggaatgtatgggggtgggggtttgtaagtttaggagaggtggttttttttgtttgatgggaatatgttaagatgttttaagcgggatttgaatgagagtttggaaagattttttgggttttaaggagttttttttatgggttatcgtgggttttgttgggatttttgtttgttgtgtgtttttggagggtttgggaggtttagagaatgaggagttacgtaggaattagggtaggtttatgtaggggtgtaggatagggtggagttgagatttttagaagggttgttatattttggtggtttttgtttgaggaattgtaggttgtttggatatgtttagtagaggtcgagggtttggggaagggaggagggacgtatgttttttgaggtttgtattggagtttatggtttggttttttttttttaggagggatggttgtggtagagggaggggaatatgaggagtattttagtttgtaggataaaatttttagggtattgggaaggggtgtttggattagggggttgtgtgatagttgtatacggttttatttgggggtgtttttttggcgagaggagagaggttatggggttttagtagcgttttgggagggtttaagtttatagtcgtgttgatatggagtttataggtaggggattggtgttagttttgtgggatatagggtttgtttggaaatgttaggttgtgggatatggttgggtttttttttagaagcgtgttttttggttttagtagggatcgtggttttatggggttatagtaaggtgttagttgggttagaagttttttaagagttaggtttgattttgggtataggattagaatttagtaatgtttagtaagttttttttaggttggataaatagtatagtttgggtttttgatttagttgttgttttttatttttaatcgtggtgaaatatataatatataatgtgtaattttagttattttgtagtgtacgttttagcggtatttagtatatttacggtgttgcgtagttgttatcgttgtttattttcggtattttttttatttttttaaattgagtttcgttttcgttagattaagttttttatgttttttttttagttgttggtagttattattttattttttgtttttattatgaatttatttgattattttaggaattttgtgtgtgtggaaaaatataataattgtttattttgtgtttggtttattttatttagtatgacgttttaaaggtttattcgtcgtgttgtagtatggggtagaatttttttttttttagaggttgaataatattttgttgtgcgatgtatttgtgttgtgtagttgtttttttatcggtggatttttgggttgtttttatatttttttaagtttttttttttattttttttgatttttttttgatttttttgagatagggttttgttttgttttttaggttggcgtgtagtggtgtgattattgtttattgtaatttttgttttttgggtttaagtgattttttagttttagttttttaagtatttaggattataggttgcgcgttattatgtttggttaatttttaaattttttttgtagagataggtttttattaggttgtttaggttggttttaaatttttgggtttaaatgagttttttgtttcggttttttaaagtgttgggattataggtatgagttatttaatttttttttggtttttttttttgaatgagagttttttagtggttagtgggtttgggggttgggaggatgtggggtttggagagggtgtgggtttggggggagattagtgttttttatgtttttatgggtatgtggagtgtatatttgttttggcgggtttggggtttgggattttgtattttttatagagggggtatcggaatatattgagtagttagaggttagtgggttttggaaggtttttttcggtttttagtgtgcgagtttcgtgtttttttttttatttttttaagtttgattttgaagagttattttgttttagttatttagatttagtgatagtggttgttggtggtatggtgttaggttaaaggtatgggtagtttgtagagtggtaggaggttgtttttttttttgttttttgttggtgtaggatttttgtttgacgtgtcggatatatttttattttgggttgatgtgtttatatttagttgagttaaataggatgtggttggggaggcggttgttatcgagttatttaaatttcggtgatggttggtgttggatgtatagggacgtggttttggttttgggggataggtagggggatgtttatggggatgtataagaatatttttttttaggggtagatatagtttagtttttaaattgtgttagagattgtgtcgggagttaggtttagggatataatttgcgggttttgttttttggagtttatcgagtcgtgagtaggatggttgggatataaggagtgtttagggagtttttttagtagtggaagtataattttattaggttaggaaggggagagaaaggtaggttacgtggaggtagtagcgtttagagttgttaggaatttggcgttttggggggacggtggttttttttatggaataggatgtatacgttggagtcggggtatgggagaaaattattagtattttagattcggttatttacggatagggatttgtgtaggtgggagtttagtttacgtggagaggttcgtgggttgggttgatagttttgagggtttaagtaagtttaggtggaggaaatgtagggatagacgagggtagggtttttttaatggaggagtgtttttgaaattcgatgggagtggtttttcggggggtttaggtttgagttttattagtttttttttcgaggtattatttgtttgttttttcgttttttttttttgtgttacgatcgttttggatacggatttagttttttttaatttagttttttgtttattttttttttaggtttatttttttttgtttttttatgtggggttgggttgggagttttttgagtttcgatatgtatagttttgattaatttttgcggtttttttgtttttcgagtattagggatttagttggtattatggggaaaggaattatggagggagtttcgtgttttttgagtagacgtttagttttttggtttttgtttgcgggagggtatttgtgttgtggtttgtttttattttagagttgtgggtgtagggtagggttttttggggttttagttgaattgtttttagattgatttttttaaagtatagtattgttgagattttttttcgtgttgagttttttttgtttatttattataggtttttttacggttgatttatttttttgtttagtttatattttttttttttttagttttttttgttttggtttttttttggttttttatatttttttttataatttttttgttttgattttttgaattttgatttttgtttttttttatattattgttttggtgaatttttatgtattttttaaaatttggtttaaatatttcgtgtttggtttgggatataaatgatttgtgtataaatttttttttttttgttagatttttttttttaaatgtgaaagtagttttttagattataaaaagtaatcgagtattttttttttaaaatgtaggaagtatagaaatgagaaagaatttaaaatttatttgtaagttagcgatatttatgtttgaggttttgttgtatagtttttaaaattttttttatgtttttattagattttgagggtagggttgttgtttttgtttttttttgtgttttttttttgttttttgttttttgagatggagtttttttttattatttaggttggagtgtagtggtatgattttagtttattgtaatttttgttttttaggtttaagcgatttttttgttttagtttttcgagtagttgggattataggcgtgggttattacgtttggttaatttttgtatttttagtagagacggggttttattatataggttaggttggtttcgaatttttgatttcgtgatttatttattttagtttttttgattttttaaagtgttgggattatgttatcgtgtttagtttgttttggtttttataaagaattttataaggggttaggtgtagtggtttatgtttgtaaatttagtattttggaggtcgaagtaggtagattgtttgagtttaggagtttgggattagtttgggtaatatagagaaattttatttttataaaaaatataaaaaattagttaggtatgatagtatgcgtttgtagttttagttattggggaggttgaggtgggaggattatttaagtatgggaggttgaggttgcggtgagttgagattgtgttattgtattttagtttaggagatagagtgagattttgttttaaaaaaaaaaaaaaaaaaaaaaaaaattttataagatattaagtaagtgatttggatataataggtgtgttatgaaattatgttgaaggagtgagttattggtggtgagttgggatggtttttttgtggtttttgtaggtagatgtagtgatttttatgggtcgtttttagagattaagtagaaatttttttggttaattttatttttaggatatttggttttttttttggaggttgtgttggagggtttagtgggtgggtgttggttttagtgtgggggttttggaaggagttagtattttaggagggagtgtgggtatttagatggttgaaggggagggagaggaagagaggcgttgtagagggtagaggtatttttgtttgttttttcgttttagggtttggtgaggtttgagttttatgttggtggggtggattttcggttttcgaggttttggttttgtttttggatttggtattttttttgttgtttttttatagaagggcgtttattttttggggttatttttggtttttttaggttttgggtggggacggttttgtttttttttttggatttttgttttttttttgttttttaatatgggtgtttttgggtggagtggggtggggttgggttgtagtatttagtattgagtttgtaagggttggttgttggtttagagttttttttattagagttattttttttcggttttttagttatattagttaagtttttttagagttgttttataaggcgggtgtttagcgttcgtttatgggtttggttttttgtttttttgggatgtttattgggggtaagagggaggttaggtttagtgtttagtttagttttgggtatgttttagttttgttttatgagttaattggttttgaattattattttattttttttagttttaattttttgatttgttaaagaggtatttgtagaggtggttgggggttgagtttttatgtatttatttattttaagaattaagaagggagtttatagtggttttggggttatttgtgaatatggatgtgaaattggggcggggtagatatggtagtatgttttagtagtttttttgtgatttagagggtttggaaatttttgttatgtgggtggagcgttgagggagtagggggttaggttttttcgagttgatgatggtgggcgtggtttttcgtatatttggttcgtatcgggtcgtgtgttttaggggtagaatagggaggaattttagtatagatagtagggttgttagtatagcgttgagtatagggttaattaaagtatagggttttttggaattatttaatatagagtagtgaagaggtggttttggggaaagtggggttagagttgagtttgagtggggggtggggagggcgggtattagtttgtaagggagggatatttattgggttttagaagtttttggtggggattagggattgtgaagttggggagagggtgattattgtgatttagggaggaagggttttatagatagtttagtttttggtttcgtgtttataggatattttatataggttttgagtttatttttggattgtggattttttgaggtagggtgtgtaggttcgtttagtattaggtgtaaggtagggggttttggtaagcgtcgagggatttattggtgtttgatgaagtagtgagtttggatcgtgttatgtttcgggttttgagtttgtaggatttttttgtggggttgtgtgtttttgtttttggaggtgtttagaaggtattgacgtttttgtcgggatgttttattcggaaggtttcgttgtttttatttttttttatttttttgagttgtttgtagagggtatttaggtttttttttattttgggattgggtttttttttttttttttttttaagaataagtatttttttttttcgaattgtttttggagttttttagatttaggtttagagtgggaagtttcgtatgtgttgggggaataggaattaatgcgggaggattggttaggttcggtgtgtttttttcgtggtgggacggggtggggttagagaatagagtttggttttagagtttaggaagagaattttttttttcgtcggtttgttaagtatcgtgtagtggtgagaggaaaggagggttggttcgggaatgtagcgggtgtcgagtagttgtggaatattttaaatagagcgtagttgcggggaagggtggggttaggaggtaggcgttgggggcggtttttttgtttcgttttttgtagttttgtggttttgattatttagtttggttttaggatggagtttcggtttttagatatatggtattgggtgaggtcgttttttagtatttgttttaggaagttagagtagttgttagaagagagaggagttgtgtttgtattcgtcgttttttaggttcgggatagttgtcgggattgagggtttgtataatggcgagtttgttcggaggggcgcgtcgcggttagatagttatgttttgtgcggtgtggatagagggtatatttagttttggaggagcgtatttagatttttcgtttcggggtttaaagtgtgggtagtttttaattagattttggattttagtagatagtttgggaggatgttatgtggtttattttgatatattgttttatttgtgattttatttttgagagttgtagggaggcgtttttttagttggattttatttttttttcggggttttttgtgggtgttataagtgattttgttttttttagtttaaggggggtttttggggtatgggttgtaattgataggttagagtagtttatggttagggttgagtttttttttcgttttttttgaatattgggtttaggaaggggttaaagtggagatgttttgattaaagttgagggaggtatggagtttttttgattttgtttttttattttattgttgttattgggtgtattttgtggagttttaggatttttaaagaatttagagtggagattttcggttttatttagtgtaggtgagggggaaagtgatttgtttatagttatatggttattattagtatatttgggttaagttcgattttattttacggtttttgtttgaaatttggaattggaaatggttttggaaattattgattttatttgtcgttttttaaaatggttcgtagaggttaagatatagatttttgtaatgttttgtttattcgtgtgtggggaaatggtagaggagtatcggttttgtttttatattgtttgggttgtcgtttttgttttgtttagtggtttttttttttggttcgtttttttattgtggaagtgggtataattttttttgtgtagcgtggttagagtggatagtgatgattcgtgaagtagggtggagcgtttgggggattcgtgttaaataagtatataaataaaagttaatataatttttatttaattagtaagtaggttttgtttgaagtttttgggtagtattttatgttatttttaggttttaggtcggtggtgtcgtttcgtgttttttttattcgtaagttggtgtttagaagttttgttttgtgttttggtttttattttttttgtgatttttttttttttttattttaaaaagtaatgtacgacggggcgtggtggcgggtatttgtagttttagttgtttgggaggttgaggtaggagaattatttgaatttaggaggcggaggttgtagtgagttgagattgtgttagtgtagtttagtttgggtaatagaataagatttttatttgggaaaaaaaaaaaaaagcgatgtttagttatttttagatagaaaatgaagattatatgaaatttggaaagaagttttttttttttattttttaatttttttttaaggggtggttatgttgatagttgggtgtggtatttttttgaattttatttttgtagagttatttagggtttgtgtaaaaaaagttaatgtgtaaatatagattttttaagaatataaaggaaattagatttttgttattagtttttattttttttatttaataatattgttgttatttgtagatgtagtacgtttttttttttttttttttttttttttttttgatagagcgtggtttaggttggagtgtagtggtgcgattttagtttattgtggtttattgtaatttttatttttcgtttttcgtttttaagcgatttttttgttttagttttttaagtagttgaaattataggtgtttgttattatatttggttaatttttgtatttttagtagagacggggttttattatgttggttaggttgtttttgaatttttgattttgagattcgtttatttcggttttttaaagtagtacgttttttttaatggttgtgttattagttgttttatggttttgttaggtttgtttagttttttattgtgattgagaggttgtaatagatgttttcgtatttgtatatgtgtatatatgattgaaggatgagtttttagtgaatttttgtgttaaggatgtgtgtatttaagttttgatttgttgggtatagtggtttatatttgtaattttagtattttgggaggttaaggcgggttgattatttgaggttaggagtttaagattagtttggttaatatggtgaaattttatttttattaaaaatataaaaattagttgggtatggtggtttgtgtttgtagttttagttatttaggaggttaaggtaggagatttgtttgaatttagtaggtagaggttgtagtgagttaagatcgtgttattgtattttagtttgggtgatagagcgagattttttattaaaaaaaaaaaaaaaaaaaaaaaattgatttttgtttttgaattggtttttaaagtggttattagaattttttaggattttttttttcgtcgatttgtttagttgtttgttgggttttgtgtagtgatggtttagtagggaggttttatgttttttatttttggttgagggttaaatgttttttaattggtgttttattttgtgtatttcggttaagcgagagggattattttttcgtatgttataggttagggttttgtgttttttttttatttggaaggtgtattttttttttgttgaaattttttaaaaagagttttttgtaagttaggcgtgatggttaatatttataattttagtattttgggaggttgaagtgggcggattgtttgagtttaggagttcgagattagtttaggtaatatggtaaaatcgtatttttgtaaaaattagttgggtgaggtggtgcgtttgtagtttcggttattcgggaggttgatgtgggaggattatttgagtttgggagtttgaggttgttgtgagttgtggttatattattgtattttagtttgggtgatagagtgagattttgtttaaaaaaaaaaaagagttatttgtatatttttattatagtaggtacgagtattttgtttttagttgtttatttttgattttgtttttgggatgtttttttatatagaatattttaattttgatattgttaagtttttgtttttttttttagtttttggaatttatattttgtttagaggttttttgcgttttgaaattataggaaagaattttatttacgtttttttttagtatttttgtggttttatttttatatgttgaaattatgaatttattggaatgtattttggttttagtagcgaggtaggggtagatggtattgtttggatatatagtagcgagtttggtttggagcgggtggggcgtgtgtgtgtgtgtgtgtgtgtgtgtgtgtgtgtgttatttttattagttttggtgtttgtattgtgttggtttagtaaaaataatttggatgtattttttttattttttgttttttggaatattttaagtagtaatataataatttttttgttaaaattttttaagaatttattcgtgaaattatttgagtttgatatttttgggggagtttagtattttaaaaatttaaattttttttatgggtttgtgagtttgggagtttttttttttttttaaaatttattattattttttttttagaaaagtgttttttagtttatttaaaattcgttagtttatttcgagggggttgttttagttcgtttagtgaggatagtgtgtagcgcggtgattgatatgattgattagtagagtacgatcgattagtcggtgtgtaaatatgattgattgtggttagcgttttgggatgttttatgttgaggtatatgtgtgtagtgtagggtgatgtgtattttgagaggggatgaagttataggatttttgtatttttaggagagagtttttttttttaaggttgtagttttgagtaggtagtgacgggattgggtttagggggttgagtggttttagtaggttaagggttttaggaattatgagaagtttggagttgtttagagagtagtttttaaaattagtttggattgtagtttttagaaagatatgcgattgatattacgaattaggatatatttatatatggggtgggggtggggatgggatgtattaatgaaattaaattttcgtgatggaatttttatttttattatgcgtgtgttatatttagtatttttttttttttttttttttttttttttttttttttttttttttgtttgtttgttttggagagagggaaggtttttttttatttttttttaaatagttttattgagatttaagtaagttattatataatttattaatttatttatttatttatttttttgagacggagttttatttttgtcgtttaggttggagtgtagtggcgttatttcggttgattgtaattttcgttttttgggtttaattaatttttttgttttagtttttcgagtagttgagattatagatatgtattattacgttcggttaattttgtatttttagtagagacggggtttttttatgttgaggttggtttcgaatttttgattttaggtgatttattcgttttagttttttaaagtgttgggattataggtatgagttatcgcgtggtttaatttatttatttaaagtgtataattttatggtttttagtttatttagagagtagtgtaattatcgttattataattaattttagaaaattgaaaatttgagaaatttagaaaattttttttttaagaagaaatttcgtagtttttagttattaattttgttttttttttttatattttttttttatttgtgtggattttttttttttttttttttttttttgagatagggttttattttgttatttaggttggggtgtaatggtttaatttttgtttattgtaatttttattttttaggtttaagttatttttttattatggtttttcgagtagttgagattataggtttgtgttattatgttcggttaatttttgtattttttgtagagatggggttttattatgttgtttaggttggttttgaatttttgggtttaaatgatttttttgttttggttttttaaagttttggaattataggcgtgagttattgcgtttggtcgattttagatattttttgtatagagaattgtacgtttggtttttgtgtttggtttttttatttggtgttatgtttttaaggtttatttatattgtggtaggtgttagtgcgtttttgagtaatattttattatggtatggattattttattgtggatagatatgttgtttttattagttgagggatattgggttgttgttatcgttggtgagtgtattttttttaaattaaaaaaaaaatgttggttattatttattagatcgtttttttggtttatagggtgggataagtcggtttgggtgagggttaggaggtggttaggtggaggcggttggagcggttttgggttgtttttgggcgtagtaggtagaggtgtaatggtagagtttgagtaggttttttgggcggatttttatgtcggtaatgtttgtttatttaagaagtttcggttaggcgtggtgttttatatttgtaattttagtattttgggaagttgaggtaggtagattatttgaggttaggagttcgagattagtttggttaatatggtaaaatttcgtttttattaaaaatataaaaattagttgggtgtggtggcgtgtatttgtagttttagttattcggtaggttgaggtaggagaatttgtttgattttaggaggtagagtttgaatttaggaggtggaggttgtagtgagttaaaattgcgttattgtattttagtttgggtgatagagtgagattatgttttaaaaaaaaaaaaaaaaagaaaaaaaaagaaatttttagtgttgttttgtgttcggtatcgaagtcgagggaaggtagtattagtatgagtttttagtttatcgggtttttgtttggagttgacgtgcgattaaggtatacgagggaagtatggcgaggtggacggtgcggaggtataaggagtaaaataaggtagatgtagtggtttagtggtttttggtggttgcgaggagcgtgggtaggatagttttaggagggtatttggagagtagggtcggttggggtaaggtgtgttaggtatttgttaggagtaaaatgtaaggggatattaaagagtttaggaattaatatagatagtatttaatgtagtattttttaatatcgaaatgatgtatagtaatttttatgatgaataaatgttggaattttaaattaagataggtttagttttgtacgtgtatagttttgttagagtttgtttagcgtggaatttgatttgtttaaaatgttgttttaaaatattgtttgatttttggattttttggtattgttttaatttttgtatttggacgaaggttttattttaattttagttggagagggttaagggttggtgaatttggttttggatttgtagagtttgtggtatttgagaggtggggttaggaataggaaggagttggtgagaacggtattcggtatgggatggggttagattagagtagtattgtggttttttttaattcgtggttttgttgttggatgtttggcgttggtgttgagttttcggttttttgaacggagtgtgatgaataacggggtcggggagtttttgggtttttttttgaagtagtagtgaagttagggatatgtcggtagtaggtagggagagggacgtttggtttgtgtttggagttagttgttttatggaggagttgggtgaggatgcggtgggaggaagatttttttagttttgtatttttcgaagtataattgagtgtttgtgtggtttgggggttattttggttcgaggatagttttgttttgtttagttaggttttgaagagttatcgggatacggatagtagttttgttgggtggtaggttgtttattttcgtttatttaacgttggaattggatgtagagtatttggatggttagttttagagtgtttttgatatttttagttattttattttttagattaggataagatgcgggattttaatttcgagttttttatgggttttattttatgtgtttttataagttattgggtttattttttggttttagggttgtttggttatttggtattttggtttttttatttgtataatgaaaataatagttttagttttttcgaggagttataagatgtttttcgtgtgaaaaattgggatttggtattagattatttggatttgaattttggttttattttttttaatttgtggttttgggttaatttggtttttttgtttttagtttttttatttatagagttattttattgagttgttgggaggatgaatataaggaagtgtatttatgtgtttagagtattgtgattttatttattattattaaacgaggtatataataagtgtttaatagatgtttagtgttattttacggattttgtgtgttttgtgtgtttttagtagttaagttttggaggtggggaagttgttgacgagttgtacgaggtaattagaaagaggaggttataggtgtaagggtttgggtgatatttgtggatagagagaggtcgatggattttggtagaggggaagggggtttttgtatatagaaaatgttttttgtatttaagatttttgtgattttggaatagaggtagtagaggtttgtaaattttaaattataaatttagaaagtatagaatattcgtagagaggattagaaatattatatattttagtgtgtatagaattttttatatagttaaataaaagtacgtttttaattgaagttgttggagagtttttgaggattttatattagataagggtcggtaagtggaagtttaatacgtaggagttattttttttgtttataaatgtttgtcgttttttttgtttatattcgtatttatgtgagggtatttataggtttatcgtttagttttatgttttgtttgttattaaaaaattttttaagaattttttagttgtaaatttttttatcggagggggggttttaggaatttagttttgttcggggttggggtattttagtatttgttgtataggcgttggttattaaaggttatgtgtcgtattcgtgggttttcggggtttggtggtatttgggtatatagtttagtggcggttttttatttgttagatattgggagtggggggttttttatttttgttttttggcggtggggggagtgtttcgagttgttatatattagaatttatcgatttatacgttgcggtattttatagttttttgatagttttttagtttgagagattattaaattgagtttttggagagggtggttgttgaggtttggatataggtgtggataggatagttttgttttatttcggagtttcgtttcggtttagttttttgtgggtttgaagtttaggttgggttagtttttgttttttagatggtcggaaaggtagtttagttttacggtttttttgttaggttttgagagtcgtttggtttttagttttgtttttttttttttttaagatggagttttattttgttgtttaggttggagtgtagtggtgttattttggtttattgtaatttttattttttgggtttaagtaatttttttgttttagttttttgagtagttgggattataggcgcgtgttattatggtaggttagtttttgtatttttagtagggatcggtttttattatgttggttaggttggttttgaatttttgattttaagtgatttgtttatttcggttttttaaagtgttgggattataggtgtgagtcgttacgtttagtttttagttttgttttgatttttttttaaggtcgtgaggatgtttacgtttttttttttttttacggtttattgatgtttttagatgttttgtaaagttatttttttttcgggagttttttagttggtgacgggggattttttggggattattgtttaggtagttatgtaggtttgtgggtcgtgtttttaggttggatcgagattcggtgtatggggtgtttttggtttgagttgaggtttttggaagttatagttaggaggtagtaagggacggttgttatgtttttttttttttgttttttagggtttttgcgggatagatttttttgtttgagttttttggttgtttatattttggttttttaaagtttagtttgaagttttaggtattttataatttgttttttttagtagtttgttttgttttttttttgtcgatgtttttgaaatttttttgtttttttttattttttggttagagagagattggagattttgtgggaattttcgaggggagggagaaggtcgttgtttgaacggaggtggtttttttttttgtttttttttaggcgggttatatttgtaggtttagttttttgttgtggtagcgtttggggtgtcggttgttttttgggtacgagttgggagttgagggaggcgtttttaggatcggagtggtaatttagttggaggaggagtaataggttcgtggttagtagtagtcgtcgtagggatttcggcgttgtatttgtgttttagttgatttttttcgtttttttagggtgggtcggggatggtggtttgttgtttagtttaggaagaagaggggtcgtaattagtagtagttattttaggggattttagcgttgtatttgcgatttagttgattttttttttttttttagggttggttgggaatggtggtttgttgtttagtttaggaggaagaggggttgtggtttttattttagaggtttttttttcggtttttttttcggtgttggtttaattgtaggtttgttttaggtcgtgtcggtatttgttgattgacgtttagcggatgttgataggagagggttgggatggggaagtagtaagtttcggttattgtgggttcgggttatagatggttgaggtattttttggttatttttaggaagtaaggttttacgtagttttcgatttatttattgttcgtgtgtattttaggaggttgtattttttaaggtttttattaggtaattttattgggttgggtgtcgttgtaaaattatttattgggtgcggtggttttttggtggggggtatggttggggaggatgcggtggaggagaagttagtttcgtggttggggggagggcggattattcgttttttgtttgttttttgaattggagtttatggttttttttttaggtgtttgggttatggaagaggttatagttttgttttatttttgtggtagtttaggggagttttggttagtttcgtgttttttgggagggcgatagtttggttaggttgtagggtaggattggaatgtagatttttgtttggttatgttgttgtttggttgttttgtttggggattttttgtttaggaagagagaagcgggtcggatagttcggtttagtgattggaagtttagttttttatgtttagtttagtaggaagtttgttttttcggaatatttgcgtgtttttgtatgtgtttttttggttggtggttttgcgaggtttttattgggttgcgttatgttttttggttattttggttttggtgtttggtttttgtgaaatagagatatttgggtagttttttatttgtgtttgtaagtttgtgtggttttagtgatggttgattttgttttatttagaggatttgggaatttttagtttaattgtttagaggagttttttttagtggggagagtttgagttgtttttttggtggatagttttttagattttaggcggatttttttgtcggtcgttttttttgttgtttttgtttttttgttttttatttgttttttatttttttttttgtagtagttagttggtacggggatttttttttttttttgggattgtgaatgagacgatttttttggtttttttgggtttagatttttttggtaatagttagtgaaatttttgttttaggtgggaggagaaggtttagtatgtggttataataacggttttaattatattatttttaaacgttggtttttatttattttttgttttgtttaatagttatttttattattttattttttagattaggaaattaaggcgtagagagttttagttatttgtttgaggtttttatagttaagtgtttggatttgaattttggagtagtttggttgttgagttgttttggagacggggtattgtgtagtggtcggggtaggggtggagttttgtcgtcgttgattttcgggttatttggagtgataatatagtttagtgtttgggtttttgtttgagattttggttggatgttaggagttcgagattttttagtttttttttgtgtaaggcgttatggggtgaaatgaaagaaaattttagttagaaggtgtttttttttttttttagttttttagttgttttggattttgaaataagatatcgttcgtttgtggggtgagtaggaatagattggaatcgtatttttttttttttagttatagttgttaggagtttatttttttttgttttttttttttgtcgtttttttttataagattgggttggatgttgttgggaaagttaataggaagttttttggttgcggtggaggtgggggtttgtgtttttttggggatcgagatgagggttttaggttggtttcggtaagagtagggaggtttacgtttttgtttgttggttttgttttttgttttgggagaaggtatttatatgttttagaatgtattttttgcgtgtatagggatggtttttgggttatttatttgaggtttattgatttttttttttggaattggagtggtttttttacggtggattgggttgagttttttgtttcggtcgacgtttttttttaggtatttttttttatcgtgttagggtgtaggttgttagtggatgggtttttattttcggggattggtagttgttacgtttattttatagtcgagatattttggtcgaaggttttgttaagttttatggagtgtagggattttttttgagacggtttttttttgtcgtttaggttggagtttaatggtttaatgtttcgtttattgtgatttcgattttttaggtttagtagtttttttattttagtttattaagtagttgggattataggtgtgtgttattatgtttggttaattttttaattttaatttttttttgtagaaatggagttttattatattttttaggttgaattttaatttttgggtttaaatgatttttttgttttggtttgttaaagtgttgggattttaggtatgagttattgtgtttagttggggtttttttttaattttttttggttttttttaggtgtaggattcgggttttagttttatgtgtttttgaatagttttgggttttgttttgtattttttgggcgcgtggttaggtttttcgtgatattagtaggagatttaggtgaagaagtaggtagaacggaatgtttgtttatttagtttcggggttaggcggggcggttaggatagtagtagtggttggtgtggttttttgggaggttagtttattggcgtggttagcgaatggggaggggagtttttttttttgtttttttttatttttggtttttgggtttttagggttaggtttttagagttttaggtggaggatggaggttagggaagttggggtaagagcgggttgggggtgggtggttaggcggattttggaaaattattttttgtaggtttcgttttttttagggagtatttagggttggtttcggggagtcgggttaatggttatttcggatggtgtaggggtttatttttatgaaatcgggtttatttttatgaaattgggtttatagaagtttttggtttcggttttgttttgttttttggtttttgtttttaaagtaggatttaggatagttttgaattttttgtcgaaatgtagttttttgggttttaatttagttttttagaattagagtttttggggtgggttttttgtttgtttagtagtttttaggggatatttgtgtttgttagagtaagtttaataagtattgttgtaaatttttcgtttttatagttttttggttcgtttttttttttttgttgggatttgtattaggattaaatgttaatattagggattaggttatatttgtgaattttgagataatatttgtattttttttttttttgaggttgttttgttcgttttgttatttaggttgaagtataatggtgtgatatttatttatggtaatttttatttttagggtttaagtaatttttttgttttagttttttgagtagttgggattataggtttatattattatatttggttaatttttgtatttttagtagagatggagttttattatgttggttaggttggtttcgaatttttggttttaagcgattcgttcgttttagttttttaaagtgttgggattataggcgtgagttattgcgttcggtttgatatttatattttgattaagttgttgtggaaatattgagttttttttgatagttttgtttatagagtgaatgtttaggaatcggcgaggtattttttatttttatttagatggcggtttggaggtagcgtttttgattttgtgatgggatttgttttttttgtttaagagattttagagatgtggtttttgaatgtgggggtttttgttggggtgggaacgggagttggttttggttattgtttagtgattttattttagtgtttcgattttagtattttcgattttagcgttttttttttttcggtttcgcgcggagattacgtggtttgcgttgagtaattttttattgttttcgtcgcgtttttgttgtagggaagtttttttagggagttagttgatatatttggtttttattatttgtttttgaataggaatgaaaggagagagtgagtaagaaagtggtaggaggtgggggttgtagagtaggggaaggttagagagaggggaggaaagatttggaaagtttaggtatgtgttttggaagtaggtgttagcgatgagtttatttggagggtggtcgttcgttttgagttttgtttggggttagtagggaatattttgttagggtatgtcgttgggagtttgtttttggtttattttttgttgttttgagcgttgagtagatttgtttttattttagggataacgtaaggaggttgttattttattttttattttattaatattttatgaattataagtgattatttattgcgttttgacgtattttaggcgttgggttcgaagttttatgcgttttatgggatgtatttgtattatcgtcgtagaaaacggtttttgttattattgtagagaaggtatcgaggtatagagaggttgaggaattggttttaggttatatagttagaagcggttgattttggttgtgaatatagggttgtttgattttaaagtttgagttggtttgtagcgaggtttatggtttttgtgttattgtttgagtttttggtcgagttttttggtttagtggggggtttagtgatttattagttgttttattatatgttgtggatatttttacggtttatttgggtgggagggaaggggttttaggaggtgggaggggtatagggaatatagtttagtttgtttgggtttaatattttgatttttaaggtattttttgagggtagtatgaggttaagtttttgtttttttttaggattttgtttttgtgagggtttcggggttttttgtttttttttgggggttttgttggttaggattatagagaagttttttgttgttgatttttttgtttttgtattttttggtaagttattttatgatttagttgttttgtttgtaaaatgggttgaataatattgttttgtttcggagggtttttgggaggattaaatgagatttgttgtatagaagttttttgtaagttatgttgattggcggtcgtcgggtttttaagtgaatgggtattcgggtattgagtgtgtggatttagtattcggaaggaggggttggggggtatttagaatttttgggaggtttggatttttgttttgtttagattttgagtttttttttggttagtttaatttttattagtagggtgagggtaattaggatttacgtatagttgggcgaagtcgagtgattatatgtggaagtttagcgttttttatgtaaagtgggtaggcggttaaagtgagttttgttttagtttttttattttcggggttgtttttggcgttttgtttttttttagagttttattgatttgtattatgtgattcgggtttgggaagatgggtttagttgtgggaggtcgtgcgggttggggattgagagtgtcggaggagggttttttaggaaaatttagttgtataggaagtcgggttagcggttttcggaagtttttgggttttgtaagttggattttttagatttgtggttgtggggtttttttttgtttgtagttgagagtttttgattcgtatttgagggttttagaggttcgggagggggatgtgatcgtgtttttagggtgaagtttattcgagtgttattttggatatagtttttatttttttttggttttttttttggttatggggacgttgtttggggggggtttttttatatggaaggagttgtagttgagttggcgggtttcgtatatttttaaggtcgtttgatttttagtttttaagtggggttgtatttattatttaggatttggagttttagttagagagggattttttattgtttttttttttgttttttgggaaaggtagggtttttgtgtttttttttatttagggatttggtatgttgggaggttaagaggaagttgtttttcgtttatttattttttaatttttttagttagtagagttttatttgtgtgtttagaatttgtgcgtggagttagaagttataaggttggtttagttgtgtttgattttggttgtgcggttttggatagttttagtttttttggagttgagtattttgatttgtagaggagaggttgttgtgtcggtttcgtagggttttgtgtagaggggagtgtgtgcggttgtgagtttaggttatgtttttagattggaggataggatcggaatagtgggttaggatggttagagggttttagttttaggaggaggtttttatattttttagtatttttatattaggaaatgtagttaggtttttaggttttttatgttaggaagtagtatttcgttttttatttttggttgtttgggtttgagaagttgagtatttttttcgaattcgagtgttttttgatttttgtttgggtagttgttttttttgaattgatcgtttgttttatatagttttttgtggtttgttcgatagggtggttagcgagttttttgtatagtatattttttttaggagtgttgtttgtgatgatggtgtaaagggtgttttttcgagttttcggaggtatgtagtggcgtaatagcgtgagtttaggagtttcggtgagtttttggatggagaatttgtttagattattttttagtttaaattttttttgggtgtttgttgtgtttggggcgttgatttatcgtggggcggtttgtgagattttacgttatttggttattttttttagtttttgtttattgtatcggttttttggtttggttgtttttggaatatgagggtttatttttacggaagaatatttatttgtttttttttggaaagtttttttttagattttttggtcgttttatttaggttttgttgaagcgttgttattttggagaggtttttttgttattcgtagttaaaatagtttttttatgtttgtgggtggttttttatggggtatggatgagtattggagagttttgtcgtttatttgtttatatgttttttgggagggtaggggatattgatttgtgttgtgggtgttttgtatgttacgggtgtttagtgaatgtttgttaagtattaggggagtataaaggagggaagtttttgtttaattggagtagttagggaagattttttggaggaagtggtatttggtttgtttagaatgtggcgatttgtttgtatgtagatattagattagagggtaaaggttattattataatttagtagatagttataagtagttaaggaattgttatgatatggattgttcgtgattggagttaagaaggagttagagatagaggtttttgtgttttggcgtgagtttttgggggaggttgagtttttagaatgtggggtcgtttgtgtagaggtcggaggtgggagatatatttgtgagtgtcggtgagtgtggggtgagttattggggttggattagaagatgggaatttttaaatttattaattagttttggtgttttgggagtgataggagacggggtttttgggggattaatttagtataagtggacgagatgggatgtaggggaaaggataaagttttttgaggttttgggaagttgagttagggtagagttatgatagggtgagttttagaagtaatataagaaaaaatagttagattgggttttttttttattgtgggagatgttttattttatttttttcgtttttcgggttttggtaatgggttgggtatagtgaatgggttttatttgtaggagtggttatattttttgggtatagttgttttatatattgtattgagatgggattcgaggtcgggaagaatagttttttttgtaggttgatattgttagttttcggggagggaaggacggtagggggtttggagtatttttttttgttatttatattttgtgtttgtttgtagggttttgagttttgtttgttttgttttagttttggttaggaatttgttggagtttataggggtagttaggttggaataggaggagattaggtcggtaggggagtcgagagggggttttggatagtatttagggttgagttattttgggtttgttcgatttgttatttggagttgttttcgtttgtttattatgtgtaaggttttgatttattcgggtttgtttaattagcgtttttttttaggtttagttagtttggttttcgttcgatttatttattgttattagtgttatttttgtattacgtaattagtttttgtagtatgttagttattaagtttagggttttttgtgtattttttgtaatttttatagtaattcgggaggtatagagaggttgagtcgttggtttatagttatatagtaggtatggggtattgttaggatttagtcggatttttgattttagggtttttttagggttttgggtgggatattggtaaggaagtaaggtatgaatattggttttgttttggatagagttcggggacggtggtttggtaggtttagttgatatagtgattttggtgtaggtttaattattggtaaagtgtttaagtatatatagaattttaattggggagataggcgaagcggttaagggagggttgtgagtgataggtggatattgtatttattggtagattagttgattttggtgttttttggagttttttaatttttttatttagaaaaagaggaattaatagttttatttttaaattgggtgggagtattatattcgaaattgaagtaaagttggtcgtgttataggttcggtagatgttagttgtgtaggtaatttagtgattatttgaagtaggttgtgcggcggtatttttattttgtagatgtagtttagagaggttagggtattaattttgggttatatagcgatagtttaggttatagagagtagtgttggatgggagggtgttggtagttttaggtataggttgggagggttgtggggttagtagagggagggtatattttttagttggtggggtttttttgtgttttagtatttatgtgggtttaaaggagttggaaggagggaggttagagttatttatgggtttagaagttgataagtaggttattgattttgaatttgttttatcgtatgtaaattggggataaatttggggatttaatgatataatgtaagaagtagatatgttatagttttggttatatagttagtgtataataagtggtaagtcgttagaggaggtagtcggtgagaatgggagtattttagtagtttttcgttttttgtttttggttgtagatgtatttgtttttggttatttgtgttttagtttcgtgtttttcggtgtgtgtgaggttaagtttttggggtggggatttgggggtgtgtttgtagtttttgaggttaagattaaggttgaggtcgaggttgaggttgaggttattttggtgaggaggaaattgtaggtggagaagttcgttgatcgtgattttgatttgatcgtaattttgatggtgtcgatgtcgttagtacgtaggttttttgttttcgttacgattggtttttgtagtttatttggttgagaggtgtgttggttttcgtaggttgtaaaatggggatattatcgttcgtttgggttatagcgtgttcgtcgattgtatttggggagggattgagggttgattgtgttgtggggatgttggtagagaattagagagggtatttaaaaaggttaatagttcggtggggagaggaggcgtaaggttggtttttgttttttgggttttgatcgaaagggaataggggatatatttggggatagttttttttttggaggaagaagggtttagggtgttggtgtggagtttgtatagatggggataatgagttggagggtgttgggtaggagttggttagtaataggttgacgagggaggttttgttggttgggtttggtttttaagtgagtattttgagttgcggggatttagggggttttagagattttagagttgagattcgggattatagaggggtgggttgtgtttagggtaatatagcggatggggtagatgttgcgaaatttgtttttttgttttttttttttttgttatagaattggatttttttagtttatggttgttaaattttttagatgtttttgggttttatgggcgttttatattggtttttttgtaggatagtagattttgggggttggttttgatggtatttattatggggtattttatgtaagtatagtgtttttacgtttagttttttagtttgtggagtaggtttgtgtttggttagttttattttgtggttagaggagggagatagtggttttggagataggagttggtttggggttgtttttttagtttttgtttttttagtttatttttttgttttgcgggtgttggttatttttttttcgttagttttatttttagttttttttgttcgagtcgtgatttgttagtagggggtagtggaggttttgaaagtttttggagaggattttgaagtagtttttataaatttgtttttggaaagttttttttgttatatttttagcggtttttttttttttaatattttttttggggttgttatgtagcggggggtggaggaatttattaggtcgtggatagagtagagttatgttgatataaattttggttgaatttatatgttttttatagttagcggtcgattattggaattagggaagtgattttatagtaagggttcgtagagtagttattacgtattttcgattttggtttttggatttagttttggaaaagaagttagattttagttatttggagttgtttagggaagattttagtttggtgtcggttgatagtttattggaattttttatttgtttggttaggtgatgttaaggggtagaggttagaagtgttaagaagtaggtcgagggtggtggtttacgtatgtaattttaatattttgggaggttaaggcgggtgaattttttaaggttaggagtttaagattaggttggttaatatggcgaaattttatttttattgaaaatataaaaattagttaggtatggtggtgtacgtttgtaattttagttattttggaggttgaggtaggagaattttttgaattcgggaggtagaggttgtagtgagtcgagattgtgttattgtattttagtttgggtaatagagtaatatttcgtattaaaaaaaaaaaaaagaagaagaataagaagtgttaagaagtatttgtttttttgattgaaaagtaatttttgttgggcgtggtggtttacgtttgtaattttagttttgggaggttgcggtgggagagtcgtttgaggttaggcgttcgagattagtttgggtaatagaggtgttaggggtagtggcgtttgtttgtagttttagttttttaggaggtttaggtaggaggattgtttgagttaggagtttgaggttgtagtgagttatgattatattattgtattttagtttttgggtgataggatgagattttgttttaaaaaataaaatataaataaaaaattaacgtttattttttgtgattttaaaaattatatttatttgtgataaaataattaaattagaaaatgtaaaggaaatgattaataataattgcgttttttagataaatattgttaatatgtttacgtttttttttagtttttttttatatagatatttaatatttattaatttgttttgaattaaagatggttttttttgttttgtatgagaattattttagttaggtacggtggtttacgtttataattttagaaagttgaggtaggtagattgtttgagtttacgagtttgagattagtttgggtaatatggcgaaattttatttttataaaaaaatataaaaattagtttggtgtggtggtatatgtttgtgtttttagttttttaggaggttgaggtaggagaatagtttgagttcgggaggtagaggttgtagtgagttaagatcgtgttattgtattttagtttaggtaacgggagtgaaatgttgttttaaaaaaaaaaaaaaaaaaaaaaaagttgttacgttgttattttttttagggatttttattttttttatttttcgtttaagatttgttttgtaaaaggatgaggttaaatagttatgggagggtggtattggatgtttaaaaaaatgtttcgtggttggcgggatttagaaataggttggggaggttttagtagagggtggattttagttgggggtggggggtagtaggggggttttttatatgttttttttgcgtgttttatggggttgtttgtgaggtcgtgtgaattagagttcggttgggaagttatatgttatttggattttgattttttttggtagtatgattttagttaatacgtttaattatgtttttttttgtaaaatgggttaatagaaatgtttattcgagatatgatgagaaataaaggtgtttatagagtaaagtgtttagaacggttttggtatgataggagtttatatgttagtgttgtcgttggtatcgttattattacggcggtattggttgttttgttttttttttgtttttgttattttttttttttagtaggtttttatttatttgtttatttatttatggtcgaggtttcgtttgtgttaggtttggtgttgagaacgggggtagagagatgggggttgtgttttgttttttgatttaagggttttttttgtaatgtgaagtttttggagattggatttttaggttgttttattagtttttttttaggttagtttaattttttcgtgttcgttttttgagttgttagaggaagagagcgggaggaaggatggagtggggtttttgtggggattgagcggggggtgtgtgaggttttggaaatggtgtttgcggtatttacgtagtattagtttttgttgtagttgttgtttggagaatatttttggattttaggatattgatgatagaaggtggaacgttttttttggaagttattaagaggggattatcgcggcggttgagtagagttgttgatttgtgagttgtggtttgattatagttattgtttttatgagcgaggttttttgtggttttttttttaggaatttttggttttttggtaggggatagtttagggttgggggtgggtagtggtgtttgtaggtttttttggagttagagaattttttgtcgtcgtggcggggttgtttttttttgttttttttttttcgttgtgtttttagttgtttcgataggatgtttttggtttgagagatagaaattttaattttgaatggttttagtttttaagagaatttggagtttttttgtgtaaaatgagatgttttgagtatcgaggatgttgtgggggattttttattttattatttttagtcgtggtgtttttttcggttataggatgttgtagttacgttgtagggaaggagagtttttttttttgtgagtttagggagtttttttatgtagtttttttattggttattgtttgagattcgatttggtggtttttgttttaaggagtagaaagggggttcgttaggttagggtggggttgggtgcgaggatttttttcggttaatagggtttgtttaggtgttcgttttgttggggtagtagggaagggatttatatgtggtattgggatacggagaggtttttgtgtttgtgacggttaaaagggatggcgttttagttacgtttttatttatttcgaggtttagtatggttatgtcggaaatagtagtatcgttttttttattgttttggtttgtttttaataggttagaggggtggggttggagcgggcgtttgatttgtggttggatttagttgttcgtggataggttgtgagtgaatttgtagaggaagggagatgggaatgtcgggatttttttttgtatttttcgaattttcgttttttgtgagttagatggggagtgtatttttgttttttttttttgggtattttttgcgtttttcgttttaggtatttgatgttgtttgtttattttttttttttgtttttttcgttggttttttttatatggttttaattaggatttttcgttcgttggtggatgggtagagaggggagtttgttgtggggtttttttcgatcgggggattttttagtatagagttttttggtttttgtagggacgttgtgtgtgtttgtgtgagtttggcgtgttagaagcgttaagttgtagttgttttgtgcgttttttatattttttattttttaaaggttttgggtttggtgtttgtgggttggggatttgtgttggggtttttaggaggtttttggtgggagaggtagggtttttttttttttaatttgggtaattttgttttggtttgttgtttgcggaaagtgttttaggatacggtggtaggattggttggggttttggttttaggtttagttttagtttttgttagatttattttttttgtgttttcgtttattttgtttattcgtagggtttgtaggagtattttgagagttggtagggtggtttgttcggcgttcgtatagggtttgttggtgggtggttgaggttgcggtgaggtttttatggttttttcgttttgtatattttttttttgttgtgttgtttcgttagtatatgagttcgtattgtttttgagtttgtagtttgttttttttattaggtggttaagtagggtggtagttagggtggtagagttttattggtttgtaggggattttttgtgggttgtaggtagttttttgtggttgaaggtgttttggtaggatttgtattatgattttcgttaaagtttacgtttaaggtatttgtgggtattttcgttttagacgtgagggttggtatttttttttgtacgtgaagtaaaggtttgtttgaaggagcgtgtggaagtttgggtgtgatgaaggtaaggatcggtggtttattttttttgtatttggattttgggtggtaggtttggggtttttagtttttaatttaggagggtagttagtcgttggaattaagagtgaattttagttgttgttgttatagttggagggaagaggggaaaggaggcgttgtaggggagtagagattttattttttttttgtcgatattaggttgtcggtgttggacggggttttggtaatcgtggtaggagtggtgatgttcgatgatggtaataagggttttttgaggatttcgagttgttttaagggttttttatttggagtaagtattttttttaatttttttaataatattgtgaaattgattttgttgttatttttattttatcgatgaggaatttatagtttagagatgttaagtaatttgtttaagtttttttttgagtatggtagagggagggttcgaatgcggaaagtttggttttagtgtttttatttttaattattgttatttattttttcggttagttttttgattgtaaaatttgaggtttagaggagtgtagtgatttggttagtttcgtacggtaggttagtggtagagttgagtagtgttttttatgttttgattttgtggttttttgaggtggtttatttttaaatacgttttttatggtggttttgttttttttttttttttgaatttgttagtttgtgtttaggtagggggagaagtagagtaattatgtcgggcgggtcgtcgtgttttagtgtcgtttgttttatatttgattggtagtagagtggtttttttttggtgtggtttggaggtgttagtggttatttattagtatagtttagttttatatatgttatttttaaaggatgttgatatagaatgaagtagttaggggaggcggacgttttggtacgagggtggcgtttttggtaattcgtagtgttgttgtttgtggttgtttttggttggtattttatttttttttggttgttttgtagttatttgagggaggttagtatgtcgtttttattttaggatagtgtgaatgtagtagcgtaagtttgttagcgtcgtattgcgggatttggaggtttttgtttttgagttttgtttttgtgtaatttttaaagtacggattttttaggggtttttatttttttatttggaaaaattttatatcgtttagggtttgaggtagggttagagtatggagacgttgttggaggattaagggagaattgagcgcgtgtttttttggttttagtttcgtgtgtgtgtttatgtatgggtattttgttatttatattggtttttacggttgggtgggagttgagttgagttcggcggttgtttttttattttgcgggtttggttggggagtgtgaggatgtttgttggaagttaacgtgtacgaaagagttaatggtggattttatttttttagttttttttttagtttttttagggaaagggtaggaatagagaggttttatttttagaggaaggggtgggcggggatatagcgttgttcggtatagttttttttgagttattttgtatgttttattttatcgatttttgtagtttagttgtttagagcggatttagaaggtggagagagggtttttaataagtagaggatggagtgaatgtgagatttattattgggatttggtaaagtaaagagttttatttttttttcgtagatgggacgggggcggggttggagttagcggggtgggggtatttagtaagagtttttttttatttttttattttttttgttatgggtttttttttttacgtagatttttagtttggaatgattagtgtttagtttttttcgttttttttttgtttcgttggagggagtgatttggtttttggtttcggttatttatattttttgttttgttgtattagtttcgtggtaggggttgcggcggaggtgggtaaaagtcgttttcgggtagttagtttttattttgggagtgattgaaagtttttgggggtttttgtagggtgagttgtttattttggttttggtaaggatatttaggagagggttagggtgtttgtatttggggtatagtataaagaatagtcgtaagtgttttttaggtaggagggtgtcgaagtattgggaagttgggatttagaagtattgtttggggtggtgagtggaagatgtaggatatagatttacgcgattgtgtagattatttggttttattttttcggtttatagtggaggaaattagaggtcgagagaggtgaagtgagttttttggggttatatagtttagttaggtttagggcgtcgattttttgttttgttttttcgtgtttattcggttggtattagtatttttgttttgatattttcgtgtggtagttgttgtgattttgtgatttttttttattttattttagtggggttttgcgagggaaagaagaatgttttatgtagaagtggttggaaagtaagaagtttggagagaagtgaggtttttgtggtttggtttgagtttaggatttatggtttggtttttagggatggagtatcgattttttttttttatatttttattttacgtttttaggagttttttatggggaagtcggaatggatttgggtttagagattgtaaatttattttgttggatgtgtggttgtttttatgtaattaatttttttacggagaagttaggggatggtttttagtattttcgggggttttttagtgaggtgggaggatttcgagaggttaggaggttgtttaagattttttgttttttagggattaggtgagggtttgtcgattgttttgattttttgatgtttttggtggggagattttagaggggtttgtcgttattatcgttagtggttttggtttgtttagttatttttttggggtggttaaattttatgttgtaaaagtttaagtgaattttagtagtggtttgggagaattatttgttacgagttaaggatggagtttttggggaggattttttgttgttttttaatttttttcgggtatatttttttgtagttttattttttgtaagaaagttaggtgtttttcgaagtttttttttggttttaggttagaggtgatagtgggggttttttgtttgcgttggtgattgtggttggttgttggtgtttggttttgttttgtattgtgtatttattgaaggcggtattattcgggttttttcggtggttatgtatgggtgagtagtttacgatatatttgtttttagtatcgtgtgggtcggggtttttagaggggttgagggtttggatggttttgtaggggggtgtttttggttttgtgatcgaaaggagttgaaggtttggagaagtcgttgggtcgaggttagtttttatagatttggcgaggagggaatagatgtttacggagttgttttaggtattgtatatattgttttattttgcgttgatagttaagaggttggtttttcgtcgatttttattttatagataatgtgtttttttagttttttagtggtggagttaggattcgaatttacgtaggtagttttttgggtttgtagttttattttttatttttttttaggatttatgttttggggttggtaggataatgatttttagagttgagtatattttaatttttagtatttgggattacgttaggtgatatggtagggttagttaaggttattaattagttggttttaaaatagggagatgattttggatgatttatacgggttcgttgttattataagagtttttaaaagcgtaatagattatttgaggggtgtagtgggagaggtttggaaggaggaaggaggttataagttaagaaatgtaggtgaatagaaaatgtaggaaaacgtagttttttttgtagtttcgggagggtgcgtagttttgtggatattttttttgtagtttagtgaggtggagtgtgggattaatttgtgttgtttgatattataagtgtgtggttatttgttatagtagtgatgggaattgaatgttattaggtagtagtgtttttatttcggaagaattaggataaatttttttgtggattttaagttttgggagattttgggtttttttggattgttttagttttgtaattataggaaaggttttttatgtttgtttgggagaagaaaatttcgtagtaaatttatttttttttttgataaatgaaggcgagggtgtgggttggatatatgttttttttttgtggattttttttgttttaatatttagaattttgtagttgaaggagattttggggggttgtttgtttgatttgtaagtgaagaaatggaggtttagggaagttaagtgattggtttagggttatgtagagttatgttggaatattaagttagatagtttagtttttgttttaaagtgtttttttttttggttggggaggagggttggagggagtggatttcgagtaatagtagtattggtaggggttggaagagtagttattgtatttaggtgttggagtttttggttattttttgtaggaattaggtgatttattatggtataggtttttttttgtttatttgtagttttgggggttttagggattagaggatattttggtttgagggttggggtttgagagaagagatggaagtatttttagtttggtttgttttcgtggcgttttgtaggtatattcggtagtttaggggttttagagaatttggttggtgggcgtttttattttgtcgtagttgtattttgtggttagtagtttgtaggatttgggttgttgtttgtggttttgaaatagttattttttgagttgagtggggattaggtgagtagatttttatattttaattgttgtgatttttttgttttggaggttggtgggtagtttggttggtgttttatggtattttatgatcggttttgttattaggttcgtgagttgttttttttttttcgggtattttgaacggtttttttgagagtttcgttttgggttttcgtttttgtaggttttcgttgtttggggcgttttttttttttggaagttgggtttttttggggatttattaagaagggttttgtcgagtgttgttaaattgttttatttggtttttatttgttttatttattattttattttaatttttatgttttttttttggttttaagatttgagtaggtagggtttgtgaggtattttaggttttttgatgttgttagtatttaggggattgttagtatatatgtagggagggaaggaatgaaggaagagatgatttggggagttttttagtttttatttgtaattggtatattgcgataaaatatttatggtattttattttttttatatattttttttttaaatttatttttatttgagatggagtttcgtttcgttatttaggttggagtgtagtagtataattttggtttattgtaatttttatttttcgggtttaagcgagttttttgttttagttttttaagtagttgggattataggcgtttattattacgttcggcgaatttttgtatttttagtagagatggggttttattaagttggttaggttggtttcgaattttcgattttaggtgattcgtttgttttcgttttttaaagtgttgggattataggcgtgagttattgtatttggttttcgtatatttataaaagagaatttgtttagaaaattttttagatgtatttttagggttttaaggtatagatatatgaagtttgttagtgagtagttgttgtttattttttttttttttttaatttagagcggtttgcgttttaagcggatagttgtttttttttttttggttttttgttgtttacgtttttatagaagtagggagaagaggtaggaaggtgacgcgtgattattcgttgggcgttcgtatagtgtcgtttgtataggtgttattttttttatttgttatttttttcgttgagtttttttttttttttgtagatgagagagtattgttttttagaggttaagaaatgggtttagagttatttagttgattagcgtgtagttagatttgaattatattttgttgatttttatgtttgtaggtttggtttgatgagatggatagttgggtggtggagattttgagattttggatggtttttaaatagggtttgtagtttttggatagggagagtttggtataaagggtttgtggagtgagttgggggagaaggtggtttagggtttttgtttttgaataaatagatggaggggttattttagcgtttttttagtttttggtgtgttgggtttttggttttgggaggagagaatggagttggtttttattttgggttgggttggtttgggtttaatttagataagttttttagtttgttatgagtgatatttttgtttgttttggtgtttttgttaaaaatatgaagggttttagaatttttatttcggtttgttttttttttagatttggagtgggtttggggttgataatagttttatgttagatagtttgagtagttattagtgttattaggtttgatattgcggtttttgtttcggagggaaaaataaggttttttttgggggattttttgttagtttgtgaaaataggtttggagttagttagcgtttttatgtttagatatttcgtgtggtttttaaagtgtttttatgttgttagtttatatgattttttttaaaattttataagggagggtaggaagtttgagtaatagtttgttaagtatttatatagtaggtggttttattgttttttatttatagataagtaaattgagttttagggtggttatcgtttgttttttaagttatttagttatttagttacggaagaggttatgattttttatattttagtgaagttgaagattttttttttcgtttttaaaaatgtttattttttagggtagtgaatatttggtgtttttgtttagcgtaagaggtgaacgtttgttattttcgtttttttttttttattagatttgattttttttttgtgacgggaatattttgtaggtagtttgttttgtttttatagattttgagaaacggggtttaaattgtcggttgtgggtgggataggcgatattgtagtgaagaggtggagtatttttgtagcggggaagaaatatattttttttatttttttaggtttagtgtttgggggtttgtgaattaaatttatttaagataaattaatgagagaaaagatagatttaattatatacgtatgggattttattgaaaaacgtgatttaaaagagtaggtagaaggtggggttcgtgattggttcgaaggtagtgagttattttagttgattgtttatagttagttatagattagattttttgttttattgttttttttttttttatttgttttgttttttttgagttagagttttgtattgttgtttgggttggagtgtaatggtacgatttcggtttattttaattttcgtttttcgggtttaagcgatttttttgttttagtttttcgagtagttaggattataggtatttattattacgtttggttaattttttgtatttttagtagagatagggttttattatgttggttaggttggttttaaatttttgatttcgtgatttgtttatttcggttttttaaagtggtgggattataggtatgagttattgtatttagttaattagttttaaaaaaaaaaaaaaaaaaaaaagaatttagggttcgtatattattttaataggaaaaaaggaaggggtgaaagtatatattatgggtcgggtgcgatggtttacgtttgtaatttcggtatttcgggaggtcgaggtaggtggattatttgaggtcgggaatttaagattagtttggttaatatggtgaaatttcgtttttattaaaaatataaaaattagtcgggtatggtggtgtatatttgtaattttagttatttgggaagttgaggtaggagaattgtttgaatttacgaggcggaggttgtagtgagttgagattatattattgtattttagtttgggtaatagagtgagattgtgttttaaaaaaataaataaaaaaaaaaaagtatatattatggtaaaataaatgagtttttggaaagataaataggtttttaggagttgagatgggagatgtgaagttttgtgataatgtttttttaggtgtggtgtggaaattatttatattttttagggaagagttagttgtttttagggagtagatttgggtttgtatattattttaataggggaaatggaaggggtaaaagtatatattatgggttgggtgtaatgtgtttagtgtaggaggtagacgtggtttatggttgttgttgaaattagtgtagggttcgattgttttgtattgagtgttgaggattttggttttgtattagttatgagtttgtagttttgggatatatttgatgttggtttaaggggaaatgaggttggaggggtagggtggttggattggatgtgggtttggggttattgttgatttataaagtggttattatacgggaataatagagttggttatagattataattagtaatattatttaaaagtaaggttatatttttaataataagttatattttaagttattattaatttataaaatatattgttggtataatgatagttttttaagaaggatataaaaaggtatgttgggttgggtgtagtgatttacgtttataattttagtattttgagaggttgaggtcggcggattattttaagttaggagtttgagattagtttggttaatatggtgaaattttgtttttgttaaaaatataaaaaaaaattagtttggcgtggcggcgtatgtttgtaattttagttacgggggaggttgtggtagaagaattatttaaaatttgggaggtggaggttgtagtgagttgagatcgcgttattatattttagtttgggtaatagagttagatttcgttttaaaaaaaaagaaaaaaaagaaaaaaagtaaaaaggtatgttgaaggtatttgtttgtggaaagttgtaatttgacgggaggtagggcgagtattttttagaaaggtggaaatgggtttttttgttatagagatttataaatatagattgaggtttgtagtttaggagatttaaaagaggtaaaggtgaataagagttaaggtttttaagttagggtttgattttgggggtgggggttatatatgatggaggatgttaggagggttttttggaggtggtgatatttattaggggggattttaggtggggtttgcgagatagtaggatttggttgaagagcgtaggttttttagataggagtgggaatttaggtttgaaaatgagttggttagattgtaggggttttcgaatgtaagggaagaattttaattttaatagaggagtttgggaagttgtttgggaaaaggagtgataaagcgggaggggttttttagtagagttttgtatgggtaggagggagcgagatgggaggtgggtgttggtaagggatgattttagtggtttaggggagtagttatagggtggaaattaattttgtggggtttgggtaggaagggattgatttgagatatcgggaagaaatagttagtaggattttggtgagagggttgggggtcggggaggggggtgtggagagtgggagtttgagtttttgaaaatagatagtgttttaagggggagatttgaggtaagatgtggagaggtagttgagttgggaagttggaacggaggtgtggttattttaggagattaagttagggggcgaggggatttttgggagttatttagattttagtattagggaatacggaggggagaaggaggggagaagaattagttggtgcgtgttaggtattgttttcgaggttagatggggtggggttggatattggttatgaggatttttttaagagttgggttaatagtgagacgggcggatattagatggttcgggttaagaagtaagtgggcggtgggaagttagaagtcgtggtgtagatttattttgagaggttgggttgtttagatagggagaaagtttatagtttgaggaggtagataggttaaaggaagagggtttgtttgtttttgagattggggtattttgaacgtttttttaggttaagtgagaagaaattagaagaggaatatgttatttaaatgtgttgaaatagtttagtagttgcgttgttttatagaaaatgtgtagaggtttttttgttttattatgtttgtttggggacggtttttattcgggttatttagggtttttttagtttgttaatttaagggtggtaggagttgtgggtgtttttagtttttttttaaggttggtttgtgggtagaaatgtgggttgtttcggggcgttatagttataaatgtatattagtttttagaattatatttttgttttttagttttttttttcgtatttttatgtagaagcgcggtcgttagtttataaaggatagggagggatattgtttttggtatttgatgggaagtatttgttgtattttattggggtgttgtttaggatggattggaaaagagttggtaggaaggttgagttttgtgtttataatttggtttggtggtggtcgaggagtttggtaggagtagagtgtaggatttgggaattgggggttggtgtatgtgtgtacgtacgtgtgtgtgtgtgtgcgtgcgtgttgggtgggtagggaggaagttgtgaaattatatttttttttttttgttgttgtgttgttgtgtgttttagtagtacgtgggtgttattatattttttagtaggtgttaatttttaagattgttttgggttttttttttagttggttgagttggaggtgggagttttaattgttttttgtggtttttagagtgggattttgttgtgggataggttggttaatggtgtttttttttttgtgatttttttgttgggtgggttacgaggaaggattgtgggtgttgtttatagataggtggatatgtggtaaggatattttgggattttttttttgacgttttttgaagggggtatttttttagttttgagatgagtttttgtggatgtgggaagtttattattttaagagtagtagttttggaaaatttaatatagaatttcgagtaggggcgggaaggggttttgtttcgtttattggttgtttggtagagttttgtataaggaagcgtttgtgttgttgtgggcggaggaatggattgagggttatattcgttttttgttgtcgttgtaattgtttattataaatttagtggtttaaagtaatagaggtttttttttttatagtgttaagggttagaagtcgattagttttatcggattaaagttaaggtgttggtagaatttatttttgttttttttagttttgggtgggaggttttgttggagttttttggtttgcggttgtatttttttagtttttgtttttatttttttatagttttttttttttttgtagttagatttttttttgttttttttttttttttttttgagacggagttatttaggttggagtgtagtggtataattttggtttattgtagttttcgttttttgggtttaagcgatttttttgttttagtttttcgagtagttgggattataggtatgtgttattatatttggttaatttttgtatttttagtagagatagggttttgttatgttggttaggttggttttgaatttttgattttaggtgatttgtttgttttagttttttaaagtgttgggattgtagttatgagttattatatttggtttgttttttttttaaaggacgtttgtgatttggggtttatttgggtaatttttttattttaatatttttagttatatttatagagtttttgttgttatatgaggtaatatagtttgggaagggagagttatttagtttattttaggggtttgtggtgtattttagggtttttttgattttaagatataaagtaagaaaataaattggtttaaggggaaaaaaggatacgttgaattttgttgttttaaatgtatatttttttattgtgttaaaatgtatagaatataaaatttgttattagtaatattgagtatatttatagtgtcgtgtaattattagtattgtttagcgttagaatttttttattattttaaagggaaatttcgtatttatgaaggatttattttttattcgttttttttagtttttggtagttattagaatgttttttgtttttataaatttatttttaataagtgtaattttgtgtgattttaaaataaataaatatgagtacgatgagttgtttattggaaggatatttatgcggggaggtcggcgtgtggagtgcgtaggttttcggacgggtaggagttgaaggggcgtggatgtgtcgtttttttttttttttgttttttttttggggttattgtttgagtatttttttttgtaaatggttttaaataatgttttagtttttacgtttgtatcgttttttagttttaggattttttattaaaaaatattttaagttttagatttatttttgggaaaattttaatggttttatttttttttttgagttagttagattttatggtttgtggcgggttgtttttgagttttgagtatttgtgagttagggaagtaggataggtatatttagggaaggggaagagtcgtcgttagttatagtaattgatatttttggaatcgtttaagagatatttagcgtgtgtttaaaatatttatttttttttttgtttgttttttgagacgaagtttcgttttgtcgtttaggttggagtgtagtggcgtgattttagtttatcgtaatttttttttttcgggtttaagcgatttttttgttttaattttttgagtggttgggattataggtatatattattacgtttggcgaatttttgtatttttagtagtgattgggttttattatgttggttaggttggttttgaatttttgattttaggtaatgtgttcgttttggttttttaaagtgttgggatgataggtgtgagttaatatatttggttatatttattttttaggagaagttttgtattttttgaaagtgaaatgtttttaggcgggtgatattgatggtgggatttgtggttttattagtgttttatgagagatgtcgttgtgtgttttattaagttgtattttattgttttttaaatgtggtttgtagatatggtgtcgagaatgatttgggaggtttaaattataatatggtttaaattaatagttttttgatgatttggtattattttaggattaaattgagattattcgaggatgggcgtggtggtttacgcgtgtaattttagtattttaggaggttgaggcgggcggattaattgaggtttgtagtttgagattagtttggttaatatggtgaaattttatttttattaaaaatataaaaagtagtcgtcggatatggtggtgtacgtttgtagttttagttatttgggaggttgaggcgggagaattgtttgaatttaggagacggaggttgtagtgagttaagattacgttattgcgttttagtttgggtgatagagtaagattttgtttttcggtaattaaaaaaaaaaaaaaaaattgagatttttcgagttgtattgtttagtatgatagttattggttgtacggggttatttgaatatttgaaatgtggtgattttaagtggagaggtgtcgtgtgtgtgaagtgtattttgggttttagagttttagtaagggggaaagaaaagaatattaaatatttgttatttttatattgattatatgttgaattgataatattttgggttttgttaagtgaatgatattaaaattaatattatttgtttttatattttttaatgattttttttttttttttttttttttttttttttaaatatggggttttatattgttgtttaggttggagtgtagtggtacgatttcggtttattgtaatttttgttttttaggtttgagcgatttttttgttttagttttttaagtagttgggattataggtggttgttattatgtttggttaatttttgtatttttagtagagatagggttttgttatgttggttaggttggttttgaatttttgattttaggtgatttgtttattttagttttttaaagtgttggtatgataggcgtgagttattgtgtttggtttgtttttatattttttattgtaggtgttggaaaatgtaaggttgcgtttgtggtttatgtgtcgtttttgttggagggttggatcgagggttagtcgagaaggttttggggttgttttatttgaatgttgagtgtgtgttgagcggtagagaattttgagaagtgttgaaggatagaggttttgtgtgggggatgtagttttaggtcggagatgttttttttgtgttttggagatttttatttggtgatagtaagaggaattattgtaagaggggcggttattttagtaaagtatttaggatgttggttttttagtttaggaatttagaggtagaggaggggaggaggttgggtttggaggagagtagggttttgggttttgggaaaagtttggggggttagaaagttgggggatagattgaggttagaggtaaagagaagaaggttcggagaggagggttaaggaagaagggttttgtttacggggagggagaggtttacggggtaggggcgtggtgggagttgtattttcgaggttttttgttgattttgatatttggttagaaaggagttttttttggtattttttgttagcggtttttggagttgttttttaggggttagtgatgagggtgttttgggttgggttgtagatagtggaaaagataggttttttttatttttagtgttggggaaattagttttttggaggaagggggagttgtattttttgagtggtcgtattttttggtttagacgtgtgtgttttgttgtaattttggcgattggtgttggtggtgtttattttatggatggggaaggttaaattttatagatattgagtgataggtttagggttttggattttagtgtttgatttagaatttaggtttttgatttgttattagttttttttttatttagatgggaatagggatttcgggtatgtagtttttttttagatattttttcggttttggtttggcgttcggagattagtagtagtagttttttacggtcgtttattgtgagggtggggagggtcgtgggattaggaggttttagggggaaagttggttatgaggagtgggaagcgacgggttagatgttagtgattgttggttggggagtcgttggacgtggttggtttgtttggttagtgtggcgggtgtttcggggttttagttatttttagttacgtgtgggggtgcgggatgggaaaggtaagagtgtgtggagtttagttagtatttaatatgaggtttcgtgggggttgtttgagggcgtagtttttagaatttagtttttggtttttagaaggtgttattaaaggtttttttttatttgagtgaattttttttagtttttagtaagttttcggaacgagtttatttttaggcgtttttttttagtgtgggagtggttacgtttttgttgggagtgatttatttgggtttagaggtcgtggtattgagatgggtttggtagattttagcgtttaggtttagtttttatagtgttagtttttttttttggggatttttttgtttgtgtttttttgggttttagtatattttaggtttgtagggagggggagaggaagagattgatttattggttaggttttttaggggttggagaggttggagaggtaggagttggattagatttgaatttagaggttttcggaggaagagtttagggtgagttgcgtttttattttttgtttttttttttttgtttttttttttttttatggttttagttagtaagtatttggggtagaggggataaatttaggtggttgtgttttagttttggttgtaggtttgaatggttttttggggtggttggttatgttttttgagagtttagttgtggcgatgtttgagtaggtaggtgggggagtatttaggaagtaggggtgttaggtagagtataaggagagagggtgtttaggttagttttaggatttggttgagaggagggggttttttacgggtatcgtttttggtaagtatagggataagggtaaggacggtatggttagaggtttttgggagttttttttttttttttttttttagtagtttttttttattttttttagggattttgttatttttttttagcgtgtggtagttttttggcgtttttttcgtgtttttaggttgtttttgcgtcgggtttgtcgttgggcgtttttatttttgtttgttttttttttttgtttttttcgttttgtttttttggagtaattttttatcgagtttttttttttaggtagtcgaggtttttttttatttttgtttcgcgttttgggaggttttttgtttcgcgattataaagtttttttgattttttgttcggttttgagttatgtgattcggtgggcgggtcgcggttttcggcgcgtttagcgtagttcgacgtttcgttgttggggtgagttttgtttttttgttttttttagttttgtattattggttcgggggtttttaggtggcgcggtcgcgaggcggattttgatggttatggtggcggtgtcgggagttacgttgtttttgggtttcggttcgaggtcggtaggatcgagcggggtttttaggagaggggtggcggggagttcgatttttacgcggggattagattttcggttttaaaatagaagaatagggttttgtgtggttatagttatttttttgtaaatatttggttaattaagttgagtggttaagtttttttgttgttcggagttttttggaatatgtttttttttcgtaaggggtttttttggtttttaggagggttaggaagaaattcgaattggttatcgttttttttaaaattatttcgtttaagttattatttttttgggttttcgaagatcggttggttggaggttggagatagttttaatgttcgaaatgtcgtaatcgaagtttttcgcggcgtcggtattgggatttagggagttgttgttatagcgtagttttggatttttggatgtgttggatatgtgtagggcgtttttgggaggagcggggagggagggtgttgttggcggggttggtttgcgtgtgttttgtttttttataatggtatgttgcgtgtcggttatgtagaggtatgttagtgagtaggggttgagggatttttttaacggatttgtttttagagggtttttttatgttgggagaattttagagattaaattatgtagttaacggggtggttttcggttttaaagtagggaggggcgaggagttttgtaggtaatgttatttgtttttgaaacgtcgttttagtgattttggggattgatttagtttttagtttgttgtattttatttttggtttttttttttttgtttttttatgtgaaatttgttgtgttttggttagaggtttggggaatagttttttgtttatttaagataagtttgtaattttttttttggagaaaaatatgttattcggaagtaggttgagtagtggttttttggtaggtttgttcggggttgtggagatagtatttgttggattaggatggagttggaatttggtttggattttatatgagaaaattcgttggaagaggaggaagtagaaaaaggttttattttttaataatgttgtgggttttttttttttatttattgttattttgttttgaaatttaatggggttacgtgtgtttttatgaatgttattttttttggttaattttttcggtagttttaggagtttttttttaggaaaaggaagaaggtgtttgtttagtatttagtatacgagtttttgttggaaaggtgggatttttgtttttttttgggttttttttaggttgagatgtggttaaggaaggtttgtggtgtggttcgttttttttaatgttcgtttttggagatttgagttgttgttgatttttagtttgttttttttgttttttggttatttttgtgtcggggtggttgagatattattgtattggttattttgtgtttttattagttttcgtttttgtaggttgttattgtgatggtgatggggttaatttagttgcggtggggaggatttattgtgtgcgtttggggggtggcgtggggtattttgggatgagaagatgcgatttttgttttgagagttttgttttaatggaaggcgggggtatagttgtaggtagaagttattaagtattgtggttagattagtattttatgttaaaaatggttttgttggtcgggcgtagtggtttatgtttgtaattttaatattttaggaggttaaggtaggtagattatttgaggttaagagttcgagattagtttggttaatatggtgaaattttgtttttattaaaaatattggttaattcgggtatggtggcgcgtgtttgtaatggtagttattcgggaggttgagataggagaattatttgaatttgggaggtggaggttgtagtgagttgagattgtgttattgtattttagtttgggtaataagagtgaaattttgttttaaaaaaaaaaaaaaaaagttttatttgggtttgggatttgtttttcgaatattgggtttattgtgttttataaggatttttatttcggaagttttagatttatttgggtaattagagtttttgggttgattattttttagttttggttagttttttgggttatcgtatttttttaattttttgttgtgttacggttggtttaagttgtttttattagataatgcgaggtatttttataggaggggataatttcgtttttaggagttttttttttttgtttttaggtttggtgtagtgtgtggtttttttgtcggtgttaaaggttttaaggtttttttaagaagtttgttattattattagtagttttcgttatttggtttttttgtatatgtaagttttttttatatatttcggatgtttagggttttcgttttttttttttggtcgggagtgtgggaagagggttttattttaatgtttgagagtagggttaatggttagggtaagttgtgggggttttttttcgtcggtttttttttgtagtttttattttaatatagagtatcgatattatttgggttttgggaagatttggaggttgattattttggaggtttttagcgttttatagttattttttggggaagaggttttttgagggatttgtggtttttggttgggattttagttttagagttttgtttttcggcgtcgagttttgatttgtttattgagtgttagttcggttttcggataggtagggatttgttttcggagtttagtagagttttgggaagtttttttaggagggttttcgagggtggcggttatgtttagttcgttgtacgtgtgagtttgtttgatgaggaattggttgggaaggcgcgggtttaattataggtttatgagggtttttttcgtttttatttaggaagtagcggagattttggtatatttagtatttgggtttgtgtttgtttagttgttggtggaattatgggagttttgtttcggggtttgtagagtagtagtgggaattttttttattttagttttttttagagttggttgtttaaattcgtcgtcgtttagtttttttttttttttttttattaattttgggaatcgtatattgtttattttatcgggtttcggagcgggtgtaggaagagagagtttaatatttagaggtttgggttttttgtaggcgtttgagttgttgtggtttgagttgggttttttgttggaattattatagtagatttaatgatttgtttgtaggagttgttttattttagtcgatttcggggttgcgggaaggggttgggttttggttttgttgggggtggggggttagtgtaaagggtttgaaaagtggtagaggtgatggtttatttgttttttttttggtcggtcggtttaaacgcgattggttttttttttttttttttttttttttttttttttttataaataatattaaatgcgatttgttaatgtatttatttgggtttagtagttggattatgggtagaagtattttagatttgttattttttttaagttaagggtggggaatattttttgtgagattttggtttttgagcgtttaagattgtttttggaattttaattttgggtcggttttaggggattgacgttgatggagttgttgatattgattttcggtttttgtatggtttttaggaagggggtttttcgttttttgtttcgtcgagtttggttggtagtattttttttttaggtttgtgttttcggtagggtttgttgttttcgttttgttttgtgggtgttaggttttaagtattaggtgattcggttattgaatggttattgaatagttatttttgttggtgtttttagtggaatgtgtatggacgtttttttttttttagatttttgttttttattttttagtttttgttttaggggttattataggattaggaggtacgtagacgtgggtggtatatttattgggtagatttagttttgaatttgtacgttttttttaagggggtttttagcgggcggggttgatggtgtcgtttttttttttgttattagaacggatatgaggattgtgttttgtcgatttacgttttgagtttttagacgttataggtgtttgtttaacgagtgtttgaatgaatggttagtattgtgtgatcgtagatttttaatttttatttaaatagtttgtggtttttgtgaggttatttcgagatagttttataagaatttttattttttttgtacgtttcgtataaggtttttttggggggttttttagaaaaagggttaaagagtagtattttttcggggatttgaatacgatttttttcggggtaggggattgttttggaagattttcggtatcgttttttatgcgttacgtgattaggagggttttggggtaggatggtgttttttgtgttttgtgtgttggggtcggaggaaatattgttcgtggtcggtgttatttgttagttttgaagattaatgatgggttggatagtggttttattgagtgggagggagaatcgttgttgtttgtagttggggggtcgggtgggtgggagtcgaggttagggagaatagcgtagatttggtacggagaggtttggaggaggagtagggggttttagttatttagggtgtagggacgttatacgaggagtaggtgtggtgtgcgtttttttgcgggttttttattttttggtttcgttatttgtattaggttttgtggtgagagggtatagagtggaggaaggtgtcgtggttagggtaggttatacgttgtgttaatggattgttgttatttgtcgtttttgtggttttgttgttaggattttttagtattaggtttttattattaggtatgggttttataggtattattggtttttcgaagttagggatagattttatagataatattgagtttttgtagttagggatgggtttttacggttagtattagattttagggattagtatcgggtatttatagttagggataggtttttatggttagtattaggttttagggattagtatcgggtatttatagttagggacgggtttttatggttagtattagattttagggattagtatcgggtatttatagttagggacgggtttttatggttagtattaggttttagggattagcgttgggtttttatagttaaggataagtttttacggttaatattagattttagtgattagtattagatgtttatagttagagatgggtttttatggttagtattaggttttagggattagcgttgggattttggatgattgaaggagggtacggttgattaaagttgtaggagttagtttggttattttgaggtattaagttattattgcggttttaggggatttagatttttttatttgtttttttgaattttggaattagatatatttgggtttagtttttgttttcggggttgtgtgtttgggatggttgttttatttttttgaagtttagtgagatggggacggttgtatagggttcggtatagatggtattcgatggtatagggttatttgtttgtatttatatagtttcggttttcgttttggttgcgtatcgagagttttatgtttagatttttgttgagtttttaagtttttggttatgttttaggtttttcgtgagaagtattattgtatggattatgtttcgggattttattttgggttgggaagtttgttttatttttttaagttttttttagaggcgttttatgttttattatttttattgtttgaggggttagataggggaatttagtgtgggaggtttagaggtgtcggagtagacgttaagcgagtttcgtgtttatgcgttgggttttggtagatattttgaatgagttttttttttaggaaggagattggggttttagtttaagttgtggttttaaattttgtgattaagagtggagaaaaggtaagatttttttttttagttttttagaatagtcgatagtggtggaaatatggggtttatattgaatttttttgtaatttgttgaagagaatttagtttatatttttaggggtggaggtttggtcgatttggtagtgtgttcgtttttttggttatagtttattttggatcgggtattttggtgtttttttttagtgacgtagtgaagttattatgacgtgtttagttggtgagaaagtgttttttgtaatgttttattttttttagagggtgaataagttttgtttattataaataattatttatagaatatatgaggtttaatttaattttgggttacggtagcgttttttgggtaaatttacgcgttattttagttagagtttgtgtttttataggttttttggatttattttgaaggggggttggattttttgtttgtttcgatgagagggttgtaggatagtttttagcgagtttttttgagggttgtaatttttttttttggtatttttttgttcgttaggaatgttttaagtttttagtagaagtttatttattatagtcgttttttattttgtttattattttttttgtttttatttatttagtagatttcgtgtatagtttagtgtaggatttagggtgggaaggtgtttcgggtgggttggagtaaggtttttagttagggcggggttttaaggtgggtttatagttaggattgtgatttgggaggtttttttttgttttgttttagtttcggtatcgtcgttgtttttgtgtttagtggagatttattggttttaggttttaaaattttagcgaggtttgtagatagggaggagttttattcgagggtagagtgattgtcgggtttatttgtttgttacgaattacgtggttttagatttgttatttttttttttttagagttatggttttttgtttgaaaaatggataatgatggttattatgttagggattattttgaggataaacggggatgaaattgaagaggtttagtacggaatttggatatagaagtgttaattgtgtgttattagttgcggtggttgttaaggtttaattatatggtagttacgggttgagtggcgggcgggaagtggggagtaggagtatgtaagatgggtatttttgaagtttttgatttagtgagataagtatatatttagttttaagatggagtgttttaggaaggtggagattgtaaaggttttgtggcgtaggagtgtgagttgtatttttgggttttttagaattttattagagtttagggaggaggttagtttagatataggggtaacgggagagatgggagtgagaaaatggtttggcgtttggaagtggagtttggaaaggtgggcgtggggatagaggagggttttgggggttatgggtttatgcgtttaggaggtggaggtagtgaacggggttacggtcggttttatacgtggtattattagttttgttgagtttgtatttgttttttaggttttttgagtgttattattatttggtattttttggtttgatttttgttttttgttcgtttgggaagagtgagattatttgtttaaagttttttagttgtttttaattattttggttgttttttggttttgtttagggttagtcgttgatttgaattgtttggtgttatttttttagatttttggggttttgttttggtattaatagttatttttatttttattatttattcgtatatttatttagtagtgttttttgggtatttatttagtaatattaaggcgttgagatgcggttgtggttaagattcgggttcggtttgtgaggatttcgtagttgttatttttttagagtatagttttagttaggtatattgtggggtttagaaagagaaattaatatattgtgttcgtttattttgagttgttataaggaatagtcgaggttggggggttatttgatttacggttttgtaggttgtataagtggtgttagtatttgtttggtttttggggaggttttaggaagtttttttttatggtagaaggtgaagggggagttggtacgttatatggcgagagagagaatttttagattttttttttttttgaaatggagtttcgttgtgttagttaggttggagtgtagtggtataattttcggtttattgtaattttagttttttgagtagttgggattataggcgtatgttatcgcgttcggttaatttttttgtatttttattagagatggggttttattatgttggtcgggttggttttaaatttttaattttgtgatttatttattttggttttttaaagtgttgggattataggtgtgagttattttatttagtttttttagattttatagtaattagatttttcggattttgtgatcgtggggagggtattaaattatttatgagggatttatttttatgatttaagttttattttttttaggttttatttttaatattagggattatattttagtatgagatttggaggggataacgtttaaattatattatacgtgatttttttgtgcgtgcgttagtttttatatttggttaagtagtagaagttttttttttgttttttgttgagagagcggtgggggagaaatgatttagggatgggaggttggtttttcgaggggttttggtgtttgtggagtgggagtgcgggaaggtttttacgttgtgtgtgtcgtgttgggttggttttttatagtttatcgtggtgtttttcgaggattgttggggaggaaagagttaattaatttggggatttagttgttgaagttattattaaatttgagtagtttaggggtttttttttttttgggttttatgttatttagtatagtggggtttaattgaatttttttttattttttaaggtttttggttggcgtggttggggtttgggatacggggagcgagagggtttgggttttttttagatttggagtgggtttattagaaatggtttaggaaatcgcgggggttatttttagtagttgggggtttttgtggttatttttttttggttttgttgagtagttttggtttttggagtttttagtaagggatgtgggggtttgttaggttagggtttttattgttgtcgttatgtatagttgtattttgtattcggggagtggggtgtcgagtggggtgtttgggaggtaggtttttttttgttttttttgtttagagattttggggatgagttgagtgagattttttcggtttttgattggttgtgtttttgttgttattttttattttttttaagtggaggtttatgatttttttttttatttaaaagggttatttagtgatttagtagattttagtttgtgttatttagggtttttttaaaaatttgtggggaggttgggtttggtggtttatatttttaattttagtattttgggaggttgaggcgggtggattatttgaagttaggagttcgagattagtttggttaatatggagaaattttatttttagtaaaaatataaaaaattggttgggtgtggtggtacgtgtttgtaattttagttattcgggaggttgaggtaggagaattatttaaatttaggaggcggaggttgtagtgagtcgagattatattattgtattttagtttggacgatagagtgagattttgttttaaaaaaataaaaataaataaataaaaataaaaatttatggggggatttttgtgtttattggttggtgtgaggagagggtgaggagttgtagagaaggtattaggttgaggatcgtttttatttttgggttatagaattgaaggaggggatatatgaaagatgtttttagattcgggttggaggttggggatattcgagggtaaggacgacgttgtttttgtttttgtttgtagaggagtgtatagggtttattagttttttgttgttgtttaagtgatagttttatggagatagaatttatatattgtgacgttgatttttttaaaatttatagtttaatggttttgttgtatttataaagtgattgtattagggttatttagagaaatagaattaatagaaggtgtgtacgtgtgtttagataaagagatttattattatgaggagttggtttattttattatagaggttggtaagtgttaagattggtagagtaaattagtaggttggagatacgggagagtttatgttgcggttttggtgtttatttgaaggtttaagatttaggagagttaatggcgtcgttttagtttcgagatttaggaaaagcgtatgtgttagtttgagtttgaagtaggaaaaatttgatgttttaggttgaaggcggttaagcgggaagaatttttttttatttaggttttgtgtttttttatttagatttttaggtttttgttataaaattataaagatttgattagaataaaatttgagaaaaaattttttttttttatcggttttggatttattggttgggattttggaaattagattgatagagattaataggaaataagtataataatttaagtaagttttatttgatatcgagtttttataaggaaatgaagatttagagaaatcgttagtttgagcggtttttgttttgttttgagataaagttttattttgtcgtacgtttaggttggagagtagtggttcgattacggtttattgtagttttgattttttgggtttaagttggggtttagttgtcggtttcgggagttgttttgaatttatttttaagttttagtttagatttttaagtagttgggattataggtatgtgttatttcgtttggttaattttttattttttgtagagatagggttttattatgttgttcgggttggttttaaatttttgggttcgagtaatttttttgttttggttttttaaagtgttggggttataggtgtgagttattgtgttcggtttaggtttgaatagtttttatttgttttgtttgttttttaaatttgtttgttgtttgttttgagtagtttttttgtttattttttttgtttgttttttgtttaggttggagtgtagtggtatgatttttgtttattgtaatttttgttttttgggtttaagttatttttatgttttagttttttaagtagttgcgattataggcgtgtgttattatattcggttgatttttgtatttttagtagggatggggttttattatgttggttaggttgttttttaatttttgattttaagtgatttggttattttggttttttaaagtgttgggattgtaggtgtgagttgttgtgtttagtttaggtttgagcgtttttatgttgggtttgatgaagagtggaaagtcgtgggaaattgtgatagagtaataaaagatgagttgaatagtgagttcgtgggggtttcggtaagatttgtgtattggggttttttttagattttttgtttttggagatgaggttgttttttttcgttgggtgtagggagggtattttttacgtgaggggtttatgatttattttagagaaggggtaggttagtgagttttttttggatttgttattttttaaatttttttagttgaaaatatttattatgttaaggtattgtattttggagtgtgcgttttaagttttgttgtttttaattgatcgggtgaggtttatttttattagagtatatagtttgttttatttaggtttttgattgtattttttttttgtttgtttcgagaatatttattagtagtgtttgtggttgtagcgtttattttaagataaatttgtcgggaagtattttgtttttattattatttttatattattttagtatatcgattttggaaataaaagatattattttgtttatagtattttatttttagtagtggtattttttttaaaaaaaaatggtaatttttagttgggtgtggtggtttatgtttgtaattttagtatttgggaaagttgaggtaggttgattatttgaggttaggagttggagattagtttggttaatatggtgaaattttatttttattaaaaatataaaaattagttaggcgtggtggtaggtatttgtaattttagttatttgggaggtcgaggtcggagaattgtttgaattcgggaggtagaggttgtagtgagtcgagatcgcgttattgtattttagtttggacgatagagtaagattttattttaaaaaataaataaataaataaaatttaaaaaaaaatagtaattttcgatcgttgaaaatgttaaattttagagaatatagtatttttataagtgatgttaatattgtttttgattagttgttggttgaagatttatttgatgaatttgatttttttagaatagacgatttagatgattttgttgttttgtttagaaataattgtaggaataatttaaaaaattttttttttttttaatttttttgttttttgagacggattttttttgttgtttaggttggagtgtagtggtacgatttcggtttattgtaatttttgttttttgggtttaagtgattttttagttttagttttttgagtttagttgggattataaggtgtttgttattatacgtggttaattttttgtatttttagtagagacggtgttttattaggttgattaggttagtttcgaatttttgattttaaataattggtttatgtcggttttttaaagcgttgggattataggcgtgagttattacgtttggttagtttttatatttaatttttatatagagtatttagttagatttgttttagttttaaagagcgtgtttatgtaaaattaagtgagtgttggtagtgagttgaattttttaaaaggtaaaagggttaaatattaaatttatttaaaaatatttttatagatatatttagaataatgtttgatcggttatttaggtgttttatagtttagtttagttgatatagaaatttttttttttttttttgagacggagtttcgttttgtcgtttaggttggagtgtagtggcgcgattttggtttattgtaagtttcgttttttaggtttacgttatttttttgttttagtttttcgagtagttgggattataggtgtttattattatattcggttaatttttttttttgtatttttagtagagatggggttttatcgtggttttaattttttgatttcgtgatttattcgttttagttttttaaagtgttgggattataggtatgagttattgcgttcggttgatataggaaattaattattatagttatatagttatcgttattaattttagtatattttattatttttaaaagagattttgtttttattagttaatttttatttttaatttcgggtttttagtttttagttatcgtttatttgttttcgtttttatgaatttatttgttttagatagtttgtataagtggaatcgtatagtatgtggttttggtgtttggttttttttatttggtagaatatttttaaggtttatttatattgtagtaggtgttggtgttttatttttttttatggtcgaataatattttatcgtggatagattatattgtgtatttttttatttgttgatggatatttgggttgtttttgttttttggtataattttgttgtgaagaattttgtagtgagtgttggtttataggtttttgtgtgaatatgtttttattttttttgggtaattgtaagattatgtggtttagttaattagtttttaagttatgtgtttgttgagggatttaggtttggtgggggtgtattgttgtgtttggttagttaggtgttgcgagttcgtgtcgtagttatttttttgtgttgtgttttgaggttgtttcgtcggtatcgggtattgtgagttttaggaggttaaagttttttttgttttattttgagtttaggtttcgttttatgaattaggatgaatggatattgaattaacgtagggatgggtggggttggggtggggacgtagagtgatttcgggggtttgtagttgggttttggttgttgatttttagttttttttgtttgttggagtttagaataagttagaaaggggaaatgtaaagttcgagtgttttttttgtggtagattggtaggtttgggtgggtgagttatttgtagttagttgtagcgtgagagaggaagtgggaggggagggagagggtgagtttggtgtaatttatttttggaaggaggttgggttgaggttgggggaagtgatttttatttttttgagaggatttttttttggggttaattttaaattaagggagataagatttttttgggggaggttggaagtgttggggtttttaggtgggtaggttttttagggttaacgttttggggaagttataagttattatgtttttggattgttatatatatatatatatatatatatatatatatatatatatatatatatatacgagtaaattgtaatataaatgtgtgtttatgaaagtgtttattttaaattattatatagtttgtaaagcgaaggttttggttcgtatttgggtatttattgtttagttagtcggtaggtagtttgtattgtagtttgttattattttttagagatgtagtcgaggagtttagttggtttggagggtttagtgggcgtagttttaggaaagtggttaggttcgggttaggtttttttttttttttagttttgggagaaattattatatgaatgtagttttttttcggagttcgggttggaagggtttgggaggggataggtttttattttaggagtttttaggtttcggttgttgtttgtgttagttgcgtgagcgtgagcgagttaggggttattattgggtggaaggaagaagcgggtattttttttaggaggttatcgttggagttttatagtaggttaattttaggttttgggttttcgggaggaggagaaagaagagaagtaggaggtgtggagggtaggttaggattagaaggtatatagggtcggggtagtgtgggagattttgggggtttttttatttaattagttaatattatagcgtttataagaatacgttattattgtagttttattattttgttttgattttagaaggtataattgatgattttagggaacggagaatttgaggaaggtttcgtaggagagggttagatgcgatcgagtaaatgtgagtcgtttgtaaattgtagagtgtacgtatagtatcggttagttttggggttagtgtttttttggtgtttagttcggtttttgtattttttagtgttcggttgggttttgtgggggttagggttgggtttggtatattagaggatttttattaagtttttggtagtgttttagttattaaatttagtttgttagttattaaattcgttttgtcggttttcgaattattttttcgttggggtcggttatgttacgttaggttttttatgtaggacggtagatggatagacgttgggattaagttatttttgggtcgcgagacgtttgattttttgttggtgttttagaagatgttagtttttcgtggtatgttttttacgcggtgtttggggattagtggtttttaaggggtttttttgttttagcgtggggagtggtttggttaaggttttagtgtttggttggagttaggtataggtttaggtgtattggttggaggttttttgtttatgggttttgtttgttttgtgtttttggtttttattgtgttttttgtgtttttgggagagattttaggggttttgagtttagtattggggttggggagtgggcggggaagagggtggggattagggtttttggttgtagaatagttaggttttaagtttttattttattttttttttatcgggcgttttattttatattgattattttttgaagaaaattttttgaatcggttttttatttcggttgttttaggaagtttatttattttttcgttttaatgttttgtggttttagaaggatggtggaagtcggaaattatgagttttatttataggcggttatatatcgaagtcgcggagacgtcgtgggaaaggattttggttagcgcggtcggtatagagggagcggtgttatcggggtagacgggaatcgtggttgtttttatgttggtttgggagagacgaggggtcggacgaaaggatagtagattggttatttatttatttatttatttatttatttatagcgttttattgggtgtttcggacgtgtaaggttttgtgggtagtgaatgcgatagattttagatagtaatcggagggttacgtgtgtaagaattgagggatttaggttgggcgtggtgttttaagtttgtaattttagtattttgggaggtagaggcgggcggattacgaggttaggagatcgagattattttggttaatacggtgaaatttcgtttttattaaaaatataaaaaattagtcgggcgtggtggcgggcgtttgtaattttagttatttaggaggttgaggtaggagaatggcgtgaattcgggaggtagagtttgtagtgagtttagatagtgttattgtattttagtttgggcgatagagtgagattttattttaaaaaaaataaaataaaataaaataaaataaaaattgaggaatttagtgtagatgagttatttcgggaaaataagtgggagttttaggaatagtatggggaagggatggtttcggtagggaggatttttgtgggtagttttgttggaagagttgaaaggtagttagagaggttgtgcgtggatggaagttgaagagtaggttaggggcgtgtgttttgttaataaagattttaagtatttattgattaggtataatattatgtgttttataaataaatattttatttgatttttagtatttttatgagatagatgttattattttattttatatgtaagaatattgaggtatagagtggttaagttatttgtttagggttatatagtacgtcggtggtaggtaggattttggagttataggaatttggtatattttaggtgtaatggaaattagttacggttttatagagggaaattattagattagtaaattttatatacgttttttggtgttttgaggaggagggattcggataggggtagttaatggtggtggttgtgagatgtgttgggttaatattgatgagagtttgggatggatgagtggattcggagtaatggaaatggagggtttaggttcggtttttggagatttagttgtaatagttgttggttggagaggttgtttatttagatgggggatggggtgggaggtaggtgagatgagagttttagagtttagtttggggtacggttattgggtttaagatgtttttagatgttggggtttgatagtgatagtggttgtagatatttaggatttagtagagggtttggtatagcggggtttagggatacgtttgtgagttaggttggtatttaagtgtgaatttggataaagaaggtggtattgttggtattgaatgtttaggggttgggtgaagttagttagggagaggggtttttaaggtattaggattgatttcgtgggtgagggcggaggaggagacggtagaggttgagagaatagttagagataggaggaaggttagtagagttatgtatagaagtttggagaagatttgaggaaaggaagggttgggtggtcgttattttttgtagttaggaggtaagggtgatttttgtgtgttttattttttagaggattggtggttttatttggttagaattttaagtttagagatgtatttgagttttatgttatggtgtaggtagtaggagttatggagtaggtttgcggggttacggtttgtttgttgttttttggtgtttttattttgagtttaggggttgtttggatgttttgtgttgtatttttttaggcggtgttttagagaggatgaaagtggttattttaaggtgtgattaggtagcggtttatgtatattgtttttttttggggagagtttgggatggaagggtatgtgtgtgtttttgagattttttgaataggttttatgtatttatttatttattttattatttatttatttatttatttatttatttatttacgtatttatttatttatttatttatttatttatttgttaatttatttatttatttatttatttatttatttatttatttatttatagttatttatttatttatttatttatttatttatttatttatttatttatttatttatttgtttatttatttatttatttatttatttatttatttatttatttatttatttatgtatttatttatttatttatttatttatttatttatttatttatttatttatttatttatttatttatttatttatttatttatttatttatttatttatttatttatttatttatttatttgtttatttatttatttatttatttatttatttatttatttatttatttatttaattatttatttatttatttatttatttattattcgtttatttatttatttatttatttatgtatttatttatttatttatttatttatttatttgtttatttatttatttatttatttatttatttatttatttatttatttatttatttatttatttttttatttatttatttatttatttatttatttatttatttatttatttatttattcgtttatttatttatttacgtatttatttatttatttatttatttatttatttatttatttatttatttgtttatttatttatttatttatttatttatttatttatttatttatttatttatttatttatttatttatttatttatttatttattaatttatttatttatttatttatttatttatttatttatttagttatttatttatttgtttatttattcgttaatttatttatttatttgtttgtttatttatttatttatttatttatttatttgtttatttatttatttatttatttatttatttatatatttatatatttatttatttatttaattatttatttttatttttattttagaaagtatttgaagttgttggggtgtgtatttggaaaatgcgttataagtttttataggtttttttttggtttttttatttttttgattggtttttttttcggatatgtaggattttgagtagtttttttgggaggtgggtgtagtttaggtaggttgtttgtaaagttaggatcgagggagttatatttaaggtattgtgggtttttaaggcgatggtattgtgggtttattgtttttagatttttttaatttttaggtttttgagtaggaggatttttggggtagggtttggagacgggaagagaaaataattttagttttttaatttttgttagtttaggtgggtgttgtatggattgggggtatttggaatagttggtttttttattttttttttttatttttttagtttttttggttataattagatagttgtgtgcgatgttttttttttttttgaaggggttatttagttaggtttttatttatggtttaggaatgtgtttttttttgtttgttttttatttttaagtaggtcgtgtttttagttttttgttgtttttgaagggtttgggtatggggtagtttttgtagtatttttagggttcgagttgatttgtatagtagaagggaattgggggaaagttttttttttatttagtatttggtagggggttattttgttgtattttagagatttttgtttaagttttgttattttagatgattttataagttgggggaggcggagttttagtttttatagtttttgttgttgttttattgttgagttttgttgtgtatttgttgataggtttgttgatagtagaaggggttggagagagggaagttttgggttttgttttttttaatttttgtttaggggatatttttgataagaggaaattttagtttgtgatagatggttagtgtttatttatttacgggggaatttttttttttttttgtaagtttgtagatttgttaggaattaaaggaatttttggttgataggttattgtggatatggttggagggttggtacgggttggattttggggttgttttgaggtaggggtcgtttttgttggaaggttttttggggtggggaaggtattagggttattttttgattttttttttgtagtggatttattttagagtttgagataaggtaagggggtagtagaaaatagaatataaaatagttttttttattatatatcgtattagaagttagaggatttatttttggtttgttttttttgtagtttaagttttgagagtggttttttaggaagtgaatggtgatggtttgtaggttagagtttgttttggtttaagattgatgttttaataggtcgcggagtttgggtgaaaaaatttaggttagggaggtggtgggttgtaaatgaaagaatagaggagggttttttttagaaagcggcgggtggtgtgaggagtttttggattttgtttaaatttgattttatcgattggggttaattgaaatcgtgttggtagaaaggtaaaattgtttgagatttttttttttataatagaggagaggtttgtttgaaagggtttggcgagggaaaagttggaggaattttggtcggtagtaaaagtggggattttcgttttttgtttcgggggcgtttcggtttttgaatgaatgaaagaggaggttggatggagatagatttatattatttgttttttttaggttttgtaaaggagtatatagggtttttgttggtttttttattttgttagttattaagaaggagaaaatattaataggggaattgtaaagttgtagttttgtttaagttttatagtggaaatcggaaagagttttagttcggagaaaaatgtagttttttgtttttgtaaattcgtgtttttttttgggaggttagagttattgtgttcgatttttaagtagggttttagagtgttttaggaggggaaggtagagttttagattttcggtattttaggttttaattaggttttgaggagacgttttttgttttatataaagtgtgaagtgtaatttgatttggagttagttaataaattagatgagttgtgtgtattttaaaaatttagtttttgattttttatttatatatatttgtataatttggttatttatatttagtgtttttatttttagaagagaataggaagtttttagtgatatttatggagtgtttgtagtagtttgggtaggttagtaggaatataatgtagtgaaaagtagagttgagatgggaaaatattttgtttttagagttttttagggatgatattttttatcgtttttgtttattcgttttggagtttatttcgtaaatagtaatttgtttttatttgagagtttttttttgtcggagtttagggatggagagtagttggttttagttttttttttttatttttttgttttttagatttattttttattttgaataattgtttttaatttgtttttttttttttttagttgtagaatttagaattttgtgtgtgtggttaaaagtttagagagtgttgtaggtaatgttgagataattttattaaattttgtaagtttttattatattaagtttgtttgttttttttaatttttattttattttattttattttatagggatggggtttcgttacgttgtttaggttggttttgaatttttgggtttaaacgattttttcgtttcggttttttagagtgttaagttatttttttaattgggatttacgggtttagggattttttgatgaatcgtttaaaatacgtgtgtgtttgtttgtttgtttttaatgtatatttttttagggagagtttttattttttattagaggtttgtggtatatatatgttttgtattattgtattagattgtgaattttttatatgttaaagattgttttaaatttgttcggaagtttcggttaataaatatttaaataaatgaattttaaatttttatgtgttattattgtttttattttgattatttttaagtttgtagtgttatttttttgttattgtgaagtagatatttaataaatatttgttaaatgaattaatgttatggttttggtttattaggattttaggattatcgtttattattattgtttatagtttttttattattttgttttagagtagttttttttttgaggtttgtttatttttgtacgtgtgtttagtttttagttttgtcgttttattatttttttttttttatttgtattttttgaattgttaatagttaataatagtttttttttttatttatttatttatatttgaagtgagaagttattattgaggtttttgtggattttgttagtttaatttggggcggttttttggaggtggagtttttagatgagggatggatattttggtgtttgttgggtagatttatttgggagttttggtaggggttttagggtagttttgtttttttattttggttgtgggatttttggtgtattagggttttttaagtaagtatttgtgttttgggagagttataggtaggtttgagagggtttttggaatttgggatttttagttcggtttagtagttggtattattattttttttgtaagggaagttatggaaattaagatgttaatgtgttttgataggtttggggtggttttaagttttgggaagagttttggtaattttttttggttggcgggtagaatttttttttggtagtttagggttttgtttttagttttttgggggagagtaattgagggaggagttggaggttaaggttttagtgttgagttgtttgtatcgtagttgtattttttgggttttggttgtaggaattttatatttttttagtttttttatggttttcgaagatttggtttggggagggggttagtagtttggggtttatttatttggttttaaattttggttttatcgtttattcgttttgcgatttttataattgataaaagttttttcggtttcggtttttttatttgtgaaatgggataataatagtggttattttataggattgtgtgatgatttattagttataatagtttttgagtagcgtttagagtaatatttggggttcggtgtagtggtttatgtttataattttagtattttgggaggttaaggtgggaggatcgtttgaggttaggagtttgaaattagtttgattaatattagtgagatttattttttaaaaaaaaaaattagagtaacgtttggtatagagagtttttagtaaatttcggttgttgtgatgagttttgtttttttatttgtttatttatttattagattttttgtcggggtttgtcgtgagttttacgttgttttgaagaaagtcgggttggggtgagcgtgatggatgaggtgtttggttttataaattttgtgtgggggggttgtggtgagaggaaatcgtatatattattatttagttattatcgtggggagattgtttggacgtagagagtaggttttgtgtgggagcggggagggtaagttttggttgcgaggtagggtttttttaggatttagtagggatttgaaggattttgtaggtatttagggagataggagaggaggagggagtagttttggtcggatattgtttttttagtattgtttgtattagggatttatttagttttaagaagtttttttgtgggggatagggagtatttgttagtttataggatttgaagtgtttttatgggtttaagtttttgggaaggtttgtaggtggtcgtagggttgtcgtaggggtgttggttttagggtttggatttaggggagtttgtagagggagggtagttggaggttgttttagtgtgtattgttacgaggtaaagtaaggagattgttgggtttacgttgggtcggggtggatggaggtaaggaagttttcgtcggggtaagggtattagttgtagatgtcggtagtttttttttggatacgggtttggaaggttgatagggtgtggtgagtgttatcggtttttttgtcgtggtttggttagtggttttataggttttcgtgggtaggaggaggatgattttgtattttgtttggttattattggtagtgatagataaggtgtgtggggatgtggttatttcggttcgtgttttgagagttaggtgtgggttgggtttggggaagataggggaatggtattgatttgattttgagtattttgttttggggtgtaggttcggttgttatttttttggagttgggaatggtattgggcggtggtttagggttttttgttttagcggtattatttttgtatttggttagtaaggttgatgggatttgtgtggatatttttgggacgtagattaggtagtatgatatatagggaggggtaggtagagaagggcggtttttgggttttggtttttaagttaggttttgtaagtttgttgtgttaagttttttttcggtattaggttaggtgggttagggttagttttggggttgtgatgagtgtgagtgtttttaaagtgtgttatgtttaatagttgttttttttttgggtattgttttttagttagatattttatagttttcgttttagttatagatagtaatttgatttttttattttcggtaggttttggggttggggtaagaatttgttattaagtgtagatgtttttagagggtgttggtttagggttgcgtggattatagtttttttatttttgttttagatttatttgtaattttggagaaaagatggtttagtggacgtttgcggggaggagggagttggtttttaggatgagtagatttgggggtagtttttattacgggatcggtgatttattgttattagcgttagtgaatggtagaggggttttggtataaggtttgggtttagaatgggaatttgtagagaaattgttaaggtttttcgttatttgatattttcgtttggttgttattttagaaatatttttgttgtaagaagatgggggagtttgtttggggtatggtttggcgatattaatttgagaattttaggtttaagtgttggtttttgggttttagttgttttttgagttgtaaagttggtttttgggtatttgtggaaaatattggattttttattttattttattttatattttgggatatatgtgtagaacgtgtaggtttgttatataggaatataagtgttatagtggtttgttgtatttattggattttttaatttagttttattagaaatgattgtttttttttttttttttcgttttttttttttttttttttttttttttttttttttttgttttttttttttttttttttttttttttttttttttttttttcgtttttatggggatataatttttatattatattattcgtcgatttagaaagtatagttgagtggtatttttttataattttttataagtattatttttaattttagaacgttttttttattttaaaaggaaacgttattttcggtatatagttatttttttttttttagtttttggaaattattaatttgcgttttgtttttatagatgtatttattttgaatatatgattagaattttaaaagatgtgattttttgtgtttggttttttgtagttggaatgtttttagagtttatttgtgttggcgtacgttcgtgtttttttatggttgagaaatagttcgttgtgttgatttagtacgttgggtttttttacgtatttgttggcggatgtgttagttatttttggagtcgggtgtgttgtgttatttacgggttgtattaggagttggggatattattgagtaagttatagtttcgggtatttaggagttcgtagagtaggagttgggagggaggttaggaggtgtatggtttgtttgttaggttggagagatttgtaaaaagttattttgagttagaaattagagtttgaggtttttgatttttagttgcggagtcgggagggaagttttgtattttgttttgattgtggggtgacgtgttagttattgtttaaattagaatttttttgagagtcgacgtgggtattgttgataattagtttggatattcgaaagaatggaaagtagggatttagatagatttttgtataatcgtgttcgtagtagggcgaggtttggaggtgcgatggggattttaacggggtagttgtcgttttgttggagtttacggtttttggggggggttataggtgttaatcgtatattatataagtaggagtgtgaaattttagggttgttaaatttagtgagggttttgtgttggtttggttatttatagtggtattttaggaaaaaaaattattttatggattttagtttttttattagtaaagagtaggttggattggaattttgtattatttagtatagttgttatttatgaaatgtggttatttaaatttaaataaaaatagaaatttcgttttttagttggattagtttagtgttaagtgtttagaagttatttgtgaatatattgtggtaattttttaaaaaacgaaaattagaattatcgtagtattttataattttatttttgggtgtggatttaaaagaatgtatagtattttaaagagttagagatatttgtatatttatatttatagcggttttgtttatagtagttagcgggtagaaataattcgaatgttcgcggttaaatgaatggagaaattaaaggcgggataggtcgggcgtggtggtttacgtttgtaattttagtattttgggaggtcgaggcgggtggattatttgaggttataagtttaagattagtttgattagtatggagaaatttcgtttttattaaaataaaattagtcgggtatggtggcgggtgtttgtaattttagttatttgagaggttgaggtaggagaattgtttgaatttggggaggtagaggtttcggtgagtcgagatcgcgttattgtattttagtttgggtaataagagtaaaattttgtttaaaaaaaaaaaaaaaaagggtggaatatataaggaatttgatttagtcgtaaagaggaagttaggatatttgtaatagtaagggtgaatttttcgggtattacgttaagtgaaataatttggttataaaaggataattttgtaggattttatttatattaggttcgtagagtagttagatttagaaaaatagtagaatggaggttgttagaggtttgggggatggggttggggagttgtttaatgaggatagtttgttttataagatgaaaaagttttggagatttgttatataataatgcgaatgtatttaatattattggattgtatattttaaaatagtgatcgtggtaaacgttatgataattaaaaggaaaagttacgtggttagtggttattacgttgagtagcgtaggtttcggacggtgtcgtggttatagataatggagtgggtgatttttattattgtttttagttgtttgagtattatggtgttttggggttaggatgaaagtgtttttgggtatgggggtttttgttttttttatttgggagttttgaaggtagattttaaagtttatttggttaggtaggagagcgaggcgggtttttgtattgttttttgcgtgcgtgtttgtttgcgggttagtcggggtttgtaaggtcgtttttcgagggaggggttgtaggaatggtttttatttgtgtagaaggtaagttattgttttacgttaatggtaaagatggggttcggttgcgttgtattattattttttaagcggggtttttggtgggtaggatgtttggtttgatttgagtttttgtagtgagtgttggtgtttgtggagggatttagttgtagttgagtcggtttttttttcgttttgggttttaggggcgttgggggcgagaaaggagagtttagggggtagcgtttttttttaggttttgttggggagggttgagggatgttggggggaggtgggggcgggtaggggttggttttagttttaggtaaaatggtttttagatttataggtagatggaagcgattttcggttacgtgggtggggattgaattgttgtttcgtaaggtaaggttttatgtttggttttaggaagcggttttaaagttatatggtttatggttagatgtagggttgtgtttttgtttatttaaaggttttggaagtttaggggagagtatttttgaagggggagtaggagtaggagtaaagttttgaaggtttttaggttgcgtggtttgggtgggggttacgtgggggtatagagagaggagttttggtttttaggttcgtttgtgggtattgtttttagtagtggagatgtgtggatttttttttggtattttttaataaggaattatattgtttttttgtttttttaattttataagataggaatttttgtgttttgtggaggttgagaagacggggaggtgtttgtgaggataaattagtttttagtttttggtttttagagttttttttttttttatttttgatgttttaggtttggggagttttttttcgatattttttgatcgttttagtgaaataggtcgagagggatggtttgaatcggttggggatgtaggttgtagttagggggtttagtgggtattttttgagttcggtttttgtttcgtaagtggaagggtagttgaattgaagttttttattgttttttttggtttggaagtttgttttttattttttgggtagagtgaggagtgggcgtgggtcgggagggttgttttttgtttgggagggttgtttatttgtttgttacgggggatgagttttttgtagtttttcgtgttgtggttttggtttttacgtcggttttatttttttgtggttgtttttgttgggtgtttatcggttttagggaaaagttatttttttttcggaggattggcgggaggggttttgtttgggagcgtgtcgtgtggtttttgttttagcgtaggatgtttgaggttagattttttttgggaggtaggatggggtaaaagttttttcgtaggtagagtagggtttggatgggtttaagtagggacgggggtatagaatagtagtcgtttagtttgcgtgggagttgagggttattaagggtagttttagtttgtggggattagtagaggtattatttttgtgattagcgagttgtttgtatttgtatgcgtatgtattagtgagtgtggcgagtttgaggtgtgttgggatttggttcgtgtattagttagttttgatgggaattagttttattttgggtatttttggaattttattgtgtgggagtatttgggtttttagtaggcgtttttcgggcgttcgtttttagttttaggtttttgattcgtgtgtggtgttttaatagtagttaggagtagggttatcgaagggatttatagatagaagaggttttagtgatttcgggaagtttagttttacgtgttttatatatttaagagtaaaatttggttttggtttgtgggtgtgtagttcgtgggcgttggttaggtatataagacggtcgtttgggttagtttagggggaggtagatgtggtgtaggggttttttttttttatgagtttaggaatagttttgtatttaggtattcgttttgtatttagtattttttttttttttaggattgttggttcgttttatgggattgaatatataattttatggggatcgacgttggttttattttttttttttataagattatttatggggatgtgggaggcggggatatacgttggttttattttcgttttttataagattattttttttgtgttttggttcgtggatcggtttttaaggtttttgagtggtagtaggcggtatagtttatttgagtagaggtgaaggagagggttaggtttatttgggtggttcgaggtagtgtggagggttaggagaggagagtattttttatttttgtttgagtagttttttagggtacggagataggagtttagggttagttttgttttggagcgtagggggtttttagtttggtatagtttttagaagaggagatgaaaaagtttggttttgggagtttggggatggagttttgttggggaggtagcgtggttgtaggatggtagttttttagaggatattacggttagggatatttattcgggggaatttttaggggtcgtttgggtaagtcgtttagtttttttgagttttagtgttttagtttttttatttaaggatgggtgtgataattatttggtaggcgtttgtgtgtgagtttttgtttcgttttaatttttttgttgttttttttttagttattgaggcggtttttagttgcgttggcgatatggtcgatatttttagagatgtcgggtttaagtaggcgtttgtattacggaacgagaaggtttcggtggatttcggttacgtggggattgattttattttggagtagatgcgtcggaaggttatgaagtagggtttcgagtttaatattatggtggtcggtgagtttttattttgtatgttatttaattaatgtcggaaattagttttagtttttagggcggtttataagtttttgggtttggtttttttttttgtaaaatggggtagtaattttgattttaaggacggattgttagtgatattgcgtgtgtatgtatgcgtttgggaggagtttatagtttttagcggttttttagaggggtttgttttgtatatttagggtttttgagatgattttggggagtttaggtcggtttggagtaggttttgatgagtggtcgttgtttttgagtaatgacgttagtttgtgtagagggttttgtggtagttgtttttttattgttgttttagtttggttttttaggttttttatcgtattttatcgtatttcggttagaggttttttagtagtttagttttagttttgttttggaattggggtttcgtggtttttatattttttggtggtttcggagagttggaggttattacgggaggtcgtcgattagtacgatttgggtagggtgagggggttaggttggagtttatagtgggtcgtttgttgtttttaaagttttttaggttttatttaaattttatagggattttgtgaagggggcgtttcgttttttaggtagaagcgaggtttagggaaggttgttaaggttttttagtttatagggtagagaatcgtagttatcgttttgatttttagaattgtgttttgtttattttacggggtttagggaggggtttggggaagtgttttcgttaggttatattttaaataaaggtgagtttgcggggtttttgtaaggtgtttgggtattttttaggtcgggtttgtttttttgatttttgttagtcgtgtacgttttttttgtttagttttgtggacgtaaatttatatttgttagttcgatatttttttttttttttttgtattgatttgggttttggtttttttggggttttggtgttttttttgttttttgtagttttatgggattcggttgtttatggttttgttgtgtttatagttgtttggaagttggtagtttgttttaagggagggcggaggtgtggggtttttttttacggtttttattttgttttgtttgttgtgggggacgtgtttgtattttgaggatttagggttgtttttcgggaagatggttggagagaaagagaggggagaggtttaaaggtagtggttaggttgggatttatttttgtgggttacggaggggttgttttgttttttagttagggatagggtgagaaggatttgggaatttttgcgttttagttatggtataggttttttttcggagttttggttttaaggagagggagaggtagtttagtagttttcgtttttcgtggttgttattgtgatagttttgttttttgggaatggtgcgtaggaggttattttatttgtttgggttttttcgtttttttaattttgagaagaatagtggttttgattttttataaaattatttttttttagggatgtcgagtgaggaataagacgtggggtagttttgtttttttttttttttttttttatggtagttgtgtttatttgtagaggtgtaggtaaggtggaggggtatttgtttggaggtttatagatttcggggagaattttagttttgttttaatttagcggggtgaggtttgtgtgtttttttttgggttttttttttgtgagttttagttttttcgtttataaaatgggattattttataaagtgagattaagcgagttaggtttcgggtagggtttttaataggttgtggttgttcgagaatttgtagtagtggtgatggtggttgtggtgatgaggatgatgggggtggtaatgacggtgatgatgatggggtgatggtgttagtggagatgatggggatgatggtgatggtggtggtgatagtggtgggatggtagtggtgatgtgggtgatggtgattgtgatggtggtggtggtggtgatggaggtgatggtgatagtgattatgagggtgatggggatggtggtggtggtgatggtgatagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgttggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgttggtgttgatgattgtgatgatagtggtggtggtgatgagggtgacggaagtggtgatgatggcgggagtgatgggatgatggtaatagtagtgatggtattgtgatgatggtgttgatggggatggtggtgatgataagggtgatgatgatggtgatgataataataaaagtaataataataaagggatatattttgtagtattttagttggtattttttagatttaaggtgtcgtggttggaatattgatataatttttgatttgaggttggttaggatatagatttggtggatagagagagatggacgaggagtgttcgtttttgggttattaaatagtttaggttagggatttttagtattagtttttgtttttttaggagtttatattttttttagaaaggtgttattaaagttagaatattagtgtaatttagggtgttttttgtgttgtgtttttttgagatagggttttattgttgtttaggttggagtgtagtggtatggttttgatttattgtagtttttatattttgggtttaagtgattttcgtgttttaggtatgtgttattatatttggttaatttttgtgttttttggtagagatagggttttattatgttggttaagttggtttcgaatttttgattttaagtaatttattttttttagttttttaaagtgttgggattataggcgtgagttatttcgtttggtcgatttttgtttttttaaaagatagggtttttgttattttggagtggtaatgattttagtttattgtagtttcgtatttttgggtttgagtaatttttttattttagttttttgcgtagttgggattataggtgttcgttattatatttagttaatgtttatattttgatgtagagatagggtttttttgtgttgtttaggttggttttgaatttttgggtttaagtaatttttttgttttagttttttaaagtgttgggattataggtatgagttattatatttggtttagggtattttttttggtgtgttgttagcgtagtttaaggtagttttgtgtagggtaaagtaatggggtttcgagtttggaggggtgtgtgtgtgtgtgtgtgtgtgtgtgtgtgtgtgcgcgtacgcgcgcgcgtgttatatgtgatttgtttgtgtgtgttgtgagagttgtgtgtgaggtatgtgtaagaggtatgtttgaggtgagttgtgtgtgtgttgtgagttgtgtatgtgaagtgtgtgtgttgtgaggtgtgtgtatgaggtgtatgtgagttgtgtgtgttgtgttgtatatgaatgttatttttttattttcgtttgttttagttatttgtggattggttgtttgtatatacggttattgtttttcgagtggtattattttgtaggttagcgttttttagtatatggttttatagattttatgggatatgcgtgagtttgtttgatgtttatattagttttacgggggaaggattgtttattttattttgtagattaggaaattgagatacggtgaggttaggtgatttgtttaggttttggtcggttagggaggagtagtttgaatatttgggttttggttgtaattattttggtgaattgtaggaatttcggttatttggtgtattttgggtagttttgggttttttcgttagttcggtttttgttttgtttaaaatttgagttattaggagattttttgtttagaaagtataaggggtataagagatgtcgatttttttaggttcggtttattttttaggagaggattgtggtttgggttgtgttggtattagagttcggttgtgtgggtttatatagttattggatattcggttcgagggtgaagttttcgggggttgtttggtagggatattgtcgggaggtagtttaggtattgttgaattttagattggagagtttcgtgtttgggtgggaggggttttatgtgtagattttgttggttttttcggagagatttttgatcggttttttattttttttttagggtagagcggtttgggtaaatttattttaattaatattttttttaaatttaaaattagtcggaagtcggtgtagtttattttagaggagcgtatttttaagattatcgagattaagtttattacgtacggttagtggtcgggagtgggttgggggtgtaggacgtttttgtttttttggagtataggggttgggggttaagattattatatatagttagtggttaggggcgggttgggggtgtaggatttttttgtttttttggagtatagagtggggggttaagattattatatatagttagtggtcgggagtgggttggggatgtaggacgtttttgtttttttggagtataggggttgggggttaagattattatatacggttagtggttggggatgggttggggatgtgggatatttatgtttttttggagtattggtgcggtgtgagggtgttcgagttaggtaattttaggtttttaagacggggattcgttgtgtttattatttttagtatgttgagtatgttggggttttggttgtgatgggttagtgtttcggatttttgtgggtttcgttatattgagttttttatagataattgagttttttattaaaagtttgataggtaaggggtttttaggggaatcgttatcggtttgtgtcggagttggttgaggaaggttattaatttttcggtgtttttttggttgttatcgttgtttatttggggttgtttcggggttagttaggtgtggggtgtttgtgagggtttttcgttttttttttgattttgcgttcgtggttttgtgtagatattgaggagaaaggcgttcggatgaagttgatagtgattgatatattagggttcggggattatattaataacgagaattggtgaggtttttttagggggaggagtattagcgggggttttagggttttttggattttatttagagttagttttagaggtttttcggttcgcgggggtgtagggtttattttttgggatttgatatgttgttaaagtcgtacgttttaggggtttgaaaattttggattaaagtagaattatttggggaattttgttgtttttaatttattatttgaggttagttcggggaggttggtttgggaggtcgagggtaaggttgtggtattttcgtttagtaagttagattttttagggtatgtattttattggaaggtggggtgttgggttttgagttttgggaatgtacgatttgtttggggagggtattttatgtgtttgttgattcgtttttattttttacgtagttggtagtttattatgaagtttattaatgattagtacgagaaatatttgtaggaggaggttaatattaatcgtaagaagcgtatttcggatattcgcgtttattgttgtttttattttattttcgttatcggttattcgtacgtttttgtagtgtcggcgtttttatgtcgggtgttttgggttttttttgttttttgggattgtaagacggtgttgtttgttttgttgttgggtgtagaggggttgagttaggggttatggtcgttagttatgaagttgggggtgtgttatgtttgtatttttaaagttttatattgatttttatgtaagtgttttgtttagtttttattttttagttgcgttttggggagttgagggttaggtaggttttgggttgttttggagtttggtggtttgtgttttgtttttttaggttaggttttggtaggtggagtgggagtttttagttaagtattcgtagcggtgattgatttttttattcgggttttgttttatgggattttttagagggtttggtgcgtttttagacgggaagtatagagattagtgttggttttttttagggttggacggggttgttgttggtgttggtgagagtttttttttttcgtcggttttgttcgtatttgacgtcgtttttagagattagtaagggcgggaggttgtatgtattttggtaggtggattttttatggttttacggattttttgtttttagttttttgtgtattttttgttagatatttgtggtttattttgagttagggttgggaggaggaggattagaggttagtaggagtggttggtggaggtagtcgtgggtggtttgtttgtatgggtgggtggagaaggtttttcgtatttgttgttttagatgtatttttttgggcggaggaagtttaggggtttggggaaattatattttgtgggtattaggtgtaggaaggagtttggttggtgggtagcgggttttatttagagtttgtgggaaaatttaagtcggagttttcgagtttattttttggtattattttttgtgggttagtaggagttaggggtagggggttagttcgttgtttatgggttttttttgaattgaatatttgtttttttaggtagaacggtttatttgcggttttgtggtagttgttttagttgttttaagttttgttttagttgaggttgatggtaggaggtagaagttttttttgatgttagttgggtaagtcgagggcgggcgggcggtttgtggtatttttgttattttttagtattgattttttggttgggattttagttaggtatgttgtttggtttcgtttaaggcgtttagttttatggggtaggggcgggttttggttatttttgtttaaatttttgttcggagcgggtttttttttagttatgtgtgtgatcgatttatttttattgtgggaaaagttcggttttagaattggggaagatggtgttttagttttagggttttgttagtttttgttatttatagttttttttatattagattttaggtttattggggttaagtaggtaaggggagtagttcgtttggtgtaggggagtagttcgtttggtgtaggggtatcgtatattggtgttagtttttattttttttgtttttttttttttagttaaagttttatagtaagacggttgttgagttaacgatagtttttttgtgtggatatgtaggggtgtggttgggattttagaatttatggacgagggtgtttggagttggttttggttcgtttggtttgtgtagtggtgttatttgtgtttgggatatattcgtgttttttttttgttttatatttatagcgtggtcgattcggttcggggttttgtttttgttagtagggattttcgtgagtttcgagttagtatttgagagtgtcgatatttgtttgggggtgggtgtttttttattgtttcgtttttttagatgagttttacgtatatttttttgttttagttttaggtttttggatatcgagtttatgaaacgtttgagtaaggtggttaatatcgtttttgttatcgttaaggcggatatatttattttggaggagagggtttattttaaatagcgggtagggttttatttttatttgttttagtttttttgtgtaatttggagacgttgtaggtttggtaggggttatttcgtttaaaggagttatattgttagggagatcgaatcgttggttattttttttagcgggtggttggtttggtggtttttggtttaggtggttgttgggggtcgtttttgagatggtttttttagtttttttatattttaaaagtagttttgtgggagtgttaattttttagtagagtttttgaggggggttttggagaagatttggattaggtagatggtgaattttttttttagggagtgaggtcgagtaggggtcgtgcgatatggtttattttgttttatgttttttttttttttttttgagaaagggtttggtttagttgttaaggttgtaatgtagtggtataattatggtttattgtagtttttattttttaggtttagttttcgagtagttggaattatagacgtatattattatgtttggttaatttttgtatttttagtagagacgaggttttgttatgttgtttaggttggtttttaatttttgggtttaagggatttttttgttttagttttttaaagtgttggggttataggtatgagttattttatttcgttttgtttggtttttattagatggaagagaagttgggttaggtgtggtggtttacgtttgtaattttagtattttgggaggtcgaggcgggtagattatttgaggttaggagtttgaggttaatatgatgaaattttatttttattaaaaatataaaaatattagtcgggtatggtggcgggcgtttgtagttttagttatttgggaggttgaggtaggagaattttttgaattcgggaggcggaggttttagtgagtcgagattgagttattgtattttagtttgggtgatagagcgagattttattttaaaaaaaaaaaaaaaaaaaaaagttttaggagggatggtttttgttattttttttttcgttatcgtttgaggtttttgttgtgggatagggaggggtatttaagtaagagggtagttttgggtttttttttttgatagggtagtatattagagttatatggggtgttttttaaaatgaaatcgaggtgtttgggttgcggtattatatttgtttcggtgggtgtgggtggggtttgtaatttatttcgttttggggttaggtgttagggatttttttagtatgtgtaggggaagatagtttatataaagtgggtgtgtttgtcggaggttatatacgggttgtggtttgtgtttgggtaggcgagtagtcgtttattgggatgtttttgttgtacgtatttatgtcgggttgttggtagggagttgagaggttattgtaggcggggtttttgttggaattggggattgtgacgagggttttttaggaagggttttaggaggggaggtttcggtaattttgagtatttttttggggttgtgatgagtaggagaagagaggtgggaggtgtttaggacgatgattttaagtttttggggagttgtagcgtcgtttaggatagtaggtgtatttgtagttgttttttttttttttaggaggtataggagttggaggtgattggtgttatagttttttagagtttgtttttgaattcgagtttggggtagtatatagtgtggaggttatgtggtaaatattagtgggtgggtagagtttgttatagggatgggtttatttttttttttttttattttagattatcgtagatttgttgtttaacggtatcgacgtgtatttttagaaggaatttgatgaggattcggaggatcggttggtgaacgagaagtttcgggtgagtggatttattaggatgttgtttttaggggatttttagtttttgttgaagggtgggttgggggtttggaggattttaagttatgaaattatatttttggggttagagggtattgagtttaggtgtttgtatttagtgttgttaggttgaggttttcgtttttgggggattttaggtttagggtagtttttttcgggggtttaggggagggaattgttttttcgtatatgtgtaattaatatcgtttgttcgttttttaggagatgattttatttgttgtggtgggtagtgattacgagtattaggttaacggtaagaggatttttgggaggaagattaagtggggtattatcgaaggtattcgtcgtaggcgtcggggttttagatagatgggaagatagttttttttgttgatttagagtttgtgggttacgtttgagttagggattcgtggaattttatttattgttttgttttatttagagggaggggtttttttgtttttatttaatttttgggaaagtgagagggtaagtggtttgtgtagatgtttttattttagattttttttcgggtagggaaagatttagggagataggagttgggatgggggtcgttaagttttggattttggtgtaggtttttttataggtatttgtgtggttttggataaatcgtttaatttttttgggtttagaaaaggggtgggttgtagttttgtgagttagatggattttcggttttttattttgttgaagtttttgggatttttatattttagttttttgagtggttgttgtaattaattagtataaacgaggggatttaaaataatataaacgtatttttatagttttagaggttagaggttcgaaattaggggttgtttttttttgaggttttgaggattagttttatttatgtttttttttttttggtggcgtttggtatttttagttgtattgtaaaggtattatatgttttaatttttgttttattgttatagggtttttttttttgtgtttttgtttcgttttttttttttttttttttttttttttttttttgtttgagacggagtttcgttttgttatttaggttggagtgtagtgttgtaattttagtttattgtaatttttgttttttgggtttaagtaatttttttgttttagtttttcgagtatttgggattatagttacgtattatttatttgatttaatttttgtatttttagtagagataggatttcgttatgttggttaggttggttttaaatttttgattttaggtgatttgtttattttgtttggttttttaaagtgttgggattataggaatgagttatcgagtttgtttttttttttttttgtttttggataaggatgtttgtttttggatttagggtttattttaagtggatgattttatttggagatttttaatgaatttataaagaaagacgttttttaagtaaggttataattatgggttttaaggtttggattttgattatgtttttgaatggatgggagtttttggggggttatagtttaatttatttttggcggtgatatttcgggagggatgggttcgaacgttttttttttttttttttttttgtttttttattttttattagaatggaagaggggaaggtgtagagggaaatgtagtaggaaaagttattttgttttgggagagtatttggttgaaaggtttagtagagtaggaagtataagttttttaattttttagggttttagtttttattatttataaagtgggtgtagtgtgttaagattttagtgagttgagagattgttttaaagattatagagttttttgggaagttgttgttttaaaaaaatggttataatgataattattaggaggtattagatatttttgtgttattggttagatatgggttatttcgttttatgttcgaagtttttcgtatttattttttttgtagagttgaagaggtgttgtgagtagaaaatttgttaagggatttagaacgggaggcggttttagaatttatagttttagttttgtattagattttttcgagatgggagtttatgtttggaggagggtgtggagaggtatacgggttttttttttgtttgtattttttttttattattatttttgtcgggtttattttgcgggagttgtttagttgggtgtagtttgggtgttttttagtattcgtttgtggtgttaggttggtttgtttttttttggtttttttgtttgtagtttttttttttttttttgtttaaagagtttttgttgtttaggaaattttttatgaaaggtaggtttgggagagttagggatggatgggtttgggacgggtcggcggttttgttatgggcgtgtttttgttgtattttggtggttaattttgagtatcgtaggtggtcggtgatagaaattgttaggaaatgtataagagagaggttttcgtatttttttgatttgtgcgttgttgagtattattggttttagttgaggaagagtttggaatttgttaggatagttgtgaggtggtggggtttattttttagtagttttatatgaggattttggaaatgtgtttttagtattgttgggtttttatattaggggttttatgagtttatagttgatttgatattcggattagtaagggttgtgttttgtttttgttttttatttggtgaatagtattttgaggtattttttttatttttagaaattattttaagtattgttaatagaaatgtggggtgtaattgattacgttatgaatttatttaatttttatgtttttgagaggcgggtgacgttattatttatattttatggatgaggaaattgagggaatgagagtaatttgttcgagttagggagtggcgattatatattttaattttagtttgagagttttattttttttgtcggttttcgttgttcgttagtgttagatgagagtgttgttggttagtttgtaggaggttttagtgtggatatcgttttatatagggtcgtggtaggagggtttaggtaaaggtaatcggtatagtattgagagtatttgagggttgggtaaggtggaggtttcggttttgtttgttggtttattaagtaaaaattagatatttttaatttggggaaaagttatgtggttttgcgatggggtagtttggagttaggtgtatgggttttgtatttcgttttagttttatgtattgtggagttgagatagatatagtttttgcgttttttatgttttattttttttttttttttttttttttttttttttttttttttttgagacgaagttttatttttttgtttaggttggagtgtcgtggcgtgattttggtttattataatttttattttttgggttttagtgatttttttgttttagttttttgagtagttgggattataggcgtttggtattaggtttggttaatttttgtatttttaatagagacgagattttattatgttggttaggttggtttcgaatttttgatttcgtgatttatttattttagttttttaaagtgttgggattgtagacgtgagtcgtggtgtttagcgtttacgttttattttcgtaagataatggggataataaaggaattataagagatatttgtaggtgtgtgaagacgaagtttattatatgggagggtatcgggtgtttttatttgttttttttgttcggttttttatttttagtgatgtcgtttattgttttttttgttaaaaggttttttgttatataatagttatatatgttaggtatcgcgtgtttatataggagttacgaagtatagtaataaaatgattattttgagatggttattagttcgagttcgagggtatttgtgggtgttcgtggttttttgtttagtttttttgagaagtggttattgtttcgagtttgggtttgtatgtattgtgtgaagtgtatatgtttttgagtaatgtttagtattgttgatttttgagtttgtgaatggtcgtttatagtacgtagtttttgtgtgtgtttttgtgtgtgtgtgttttgagcgtatataaggtggatggggtcgtgggggtaatattttgtgggttataggttttttttaaaattttagtttcgatttttgttttattttatttttagtagtttagttttttgtttgtttttaggtttttgttgggacgttttgttttttttggttattttagtggtgcgggggtttattgttttggtttttttattgtggtttttttttatgtttttatttggtttggttattgtgttattttttattagttaggaattttttggagagtaggagttgagttgtttaggagtaggagttggtgttggttattttagtattttttagattgagggtagtgttaggtgttttatatttagttgtagagtaggtggtttttttgtttttttgtttatggggttgtttttagattttgtttttggtattagtatttttgggtagggggagagaggtggggttcgggtagagtttttttattgggatattaaagttttttttgtttttttttttagttgaaaatattatatattgtgagtttgtttatttgcgggatttttttattaggtgagagatagggtgtttgggtggggttgacggttttatttttaagagggttttatagcgggtgggggtagtgggtgtggggtcgaagttttgggtagagtgggtgttttttgttatttgtttgttttgttttcgggaagattttggaagtttattttttgaaaaagaaaatttattgggaaatgaagtaggtagtgaagattttttttaatttttgcgaagttggttggatgggaaggttgagttttgatttattgtggtttggttcgttagagttgttcggtggttattaagggtttagtgaggttttatgtgtaggttttgtcggtagcgtggggcgtttttagtttcgattttattggtttttgatttttattttttttatttggttgaggtttttttttgttttttttgagtttaggtaaggaggggaagttttgatggagagggtgttgggtgggtggtttttggagtgtgggttttggtttgggtaggtttttttttagtaagtagttggtatggatgatgggaatgttattaagaggaggggtttttaggttggcgggggtaggggtggggggatttcgggagtcgttttgttattgtggggatattgggttttttaatttttttttagattattttttttgagttgtagaggaatgaaaattcgagtttaggattttttttttttggggataagggtaatttagttttttgttttaggttatttgtttgttataggttatagttttggaggtcggtggttatttattgtttttattttgttagtattttggatatcggtttggagtaataatgttttagttttgtttttttgagtttatgtattgtttttgggttttggatttagggttatagggtggatttagagggagatatatgtattggaatatgtgtgttttgatcgagtttgggtttattagggggattgattttttttttaaaacgtgtattagatttggtttaatatggtgggtttgggggattttatggggagttaagtagtcgggatggggagtgggggtgggggtaggcgggtttgagttcgaggtaggtcgagtagggtttttgtttcgttgtttttatttcgttgcgtttattttattgattcgttcgttttttatttttataggacgtatatgtagaatattaaggatattattagtagtatttatttcgaggcgtatcgtgtgaagcgttttaacgagggtagtagcgttatggttaacggtatggaggagaaggagttagaagtttcggagatgtagacgttattttgtttattttcgggattttgtttttaagttattttcgtttttttttaggtttttttattattttattttattttatatgattttttttatttgttatcgttttttattttttcgatatgttgttaggaaataagggaaggggttttttttcgagtgagttagtgatgaggtcgcggttttttcgaggttgtggggaggttgtattggagttataggtaggggtgagagtatttattgaattgatatgattttttgtttttaggtttggtttttcgagggtttagaagagtagtttcggtgtgtagattattcgtttgtgtggggtttttagtgtcggaggttttggggtgggggttaggtttcgtatttgtagaggagtttagtgggttgtacgtttttttttatttttatcggttttgttttttggagtgtgttagagtttaggggagaatgtagtttattaggagtatttggattttttgttcgttatatggtgtggttattatttagtttttatttttgttttgtttttaagggtagaaaattttagggttttttgttatcgattgtttagttattttaagttttttggtagttgttttttttggagtagaaagtgtttttattttagttattcgtagattgtttggttagatgcggggataggttggaatgagggaggcgtttttatttttttgttattttttttttacgttattttcgtttttatcgggttgtaggtgttgttgatgcgttgggatttgattgaggataaaaaggaaggagagatgatttttatttttttattttttagttttgaaaaggtttaagtaagtgagtttggtggaggagttgagggagggagttatggaaggtgttagaaggaaggttggcgggggtacgtgtgggtcgtggtttgggttggttagagtggcgtgagttgttcggcgtttgttttgtttaagtgattagggaagtgtgtgtgtgtttatgtgtatgcgtgttcgtttgtttgtttagtgtttgggtttggtttaagattgggttgtagttatattaatgtttagttagttatttttgttatttattttttttggtttaggttttgttgattttttgagttggggaggtgggaggttaggcgagtttgattttgttgatttattcgtgtttgggtttttttttttagagtttatggtaacgaatttttagaaaggagagaacgggcgttaggggtgtatagtttatagttgaagagtaaggtttcgtggtagtacggttcggttttttattttttgtttttacgaggggatttatgggggttgtttttgtagggtatagatgattaaagtttttttttgttttttgttatttgttttgtttttggggagaaagaggggtttgatgagattttatttaggtgtatatattattaggtgtatttgtaggtatcgggttggttgtttgtagttaggagaaggttagcgagaaggagtgtatgagtgtgagtgtgtgtgtatggaagttggggtattgggcgtttgattttttttttatttaagagaggaaggattttttattatttttattggtgagatagtttattttgttaatttgttatgtttttgttaaaattaagattttgaaggaaatgagtggttagcgttagggtttaggttatgtggtttgtttagttttaatgttatttggtggcggggtggggtgggggtgggtagtagtattttagttttgagatgttttattttttttttttgtaattagattttgaaaaattgttcgttttattaggttttgttttttaatggttttttgttacgtgtttttcgagaaatttgtttttttgtataaatgataaagtgttgaaaatgtattttttgaaataaatgttttaaatgtagaaattta

SEQ ID NO: 5 - DNA, 219909 bp, Artificial Sequence
  chemically treated genomic DNA (Homo sapiens)
tgggtttttgtatttgaaatatttattttaggaaatatatttttaatattttgttatttatataaaaagataaatttttcgggaggtacgtagtaaaaggttattgaggaatagagtttgatgaaacgaataattttttaaagtttggttatagagaaggaaagtgaagtattttaaggttgggatgttgttgtttatttttattttatttcgttattaagtgatattgaggttgggtaggttatatggtttgggttttggcgttggttatttattttttttaaaattttggttttggtaaaaatatggtaagttggtaaagtaaattgttttattagtgggggtggtgaggggtttttttttttttgggtggggagggagttagacgtttagtgttttaatttttatgtatatatatttatatttatatattttttttcgttgatttttttttggttgtaagtagttagttcggtgtttgtagatgtatttggtgatgtgtgtatttgagtggagttttattaggtttttttttttttttaggagtaagataggtaataggaagtaggaagggattttggttatttgtgttttgtaaagatagtttttatgggttttttcgtggggatagagggtgaggggtcgggtcgtgttgttacgaaattttgttttttagttgtggattgtgtatttttgacgttcgtttttttttttttaggggttcgttattatgggttttgaggggaggggtttaggtacgggtagattaatagagttaggttcgtttggttttttatttttttagtttagagagttagtaaggtttgggttaggaagggtgagtggtaggggtggttggttgggtattaatgtaattatagtttagttttgggttaaatttagatattagatagatagacggatacgtatatatatggatatatatatatttttttggttatttgggtagggtaggcgtcgggtagtttacgttattttgattagtttaagttacggtttatacgtgttttcgttaattttttttttggtattttttatggtttttttttttagtttttttattagatttatttgtttagatttttttaaaattgggggatgagggggtaggggttattttttttttttttttatttttaattagattttagcgtattagtagtatttgtagttcggtgggggcgggggtggcgtgagagggggatggtagggagatgaagacgttttttttattttagtttgttttcgtatttggttaagtagtttgcggatggttgagataaaggtattttttgttttaggaggggtagttgttagggggtttggagtggttgggtagtcggtggtaggggattttggagttttttatttttaggagtagggtaggggtaggggttgagtgatggttatattatgtggcgggtagggggtttaggtgtttttggtgggttgtatttttttttgggttttgatatattttaggggatagggtcgatggggatggaggggagcgtgtagtttattgggtttttttgtaagtgcgaggtttggtttttattttaaggttttcggtattgagaattttatatagacggatgatttgtatatcgaagttgtttttttgagttttcggggagttaggtttggggatagagggttatgttaatttagtgggtgtttttatttttgtttgtggttttagtgtagtttttttataatttcggggaggtcgcggttttattattgatttattcggagggaggtttttttttttgttttttggtagtatgtcgaaggggtggggaacgatgataaatggagaaaattatataaaataaaatggggtggtgggagggtttggggggggacggaaatgatttgggggtaggatttcgggggtgggtagggtggcgtttatattttcggggtttttggtttttttttttttatgtcgttggttatggcgttgttgttttcgttgaggcgttttatacggtacgtttcgaagtggatgttgttggtgatgtttttgatgttttgtatgtgcgttttgtgggggtggggggcgggcgggttagtgaggtgggcgtagcggggtgggggtagcggggtaggggttttgttcggtttgtttcggatttaggttcgtttgtttttatttttattttttatttcgattgtttggttttttatggggttttttaggtttattatgttggattagatttggtatacgttttgggggaagggttagtttttttggtaagtttagattcggttagaatatatatattttagtgtatgtgtttttttttgggtttattttatggttttgggtttagggtttagggatagtgtatagatttagagggatagggttggagtattgttgttttaggtcggtgtttagggtgttggtagggtggaagtagtgggtgattatcggtttttaggattatggtttgtggtaggtaggtggtttggggtaaagggttgggttgtttttgtttttaggaaaaaaaagttttgggttcggatttttatttttttgtagtttaggaggaataatttggagggaggttggaaagtttagtatttttataatggtagaacggttttcggaatttttttatttttgttttcgttaatttggaggtttttttttttgataatatttttattatttatgttagttgtttgttgaggaagaatttgtttaggttagggtttatattttagggattatttatttagtattttttttattagggttttttttttttgtttggatttaagggaaataaggagaagttttagttaggtgaaaggggtaggggttagaggttagtgggatcggagttggagacgttttacgttgtcggtagggtttgtatatgaggttttattgggtttttagtggttatcgggtagttttaacgggttagattatagtggattaaagtttagtttttttatttagttaatttcgtaggggttgaaaaggatttttattgtttgttttattttttagtgggtttttttttttagaagatgggtttttaagattttttcgagggtagggtaggtaggtggtagggggtatttattttgtttagggtttcggttttatatttattgtttttattcgttgtagggtttttttaggggtgaagtcgttagttttatttaagtattttgttttttatttgatgagaaggtttcgtaggtaggtaaatttatagtgtgtggtgtttttaattaggagaggagataggaggggttttaatgttttagtggagaaattttgttcggattttatttttttttttttgtttagaaatgttggtgttaaaagtagagtttgagggtagttttatgggtaggagggtaggggaattatttgttttgtagttgagtataggatatttggtattgtttttagtttgggggatattggagtgattagtattagtttttgtttttggatagtttagtttttgttttttagaaagtttttggttaatgggagatggtatagtgattaggttaaataggagtatggaaggaagttatagtggagaagttagggtagtgggttttcgtattattggggtgattagggagagtaggacgttttagtaggggtttgaagataggtagggggttgggttgttgggaatgggatgaagtaggaatcggagttgggattttaaagaaaatttgtggtttatagggtgttatttttacggttttatttattttgtgtgcgtttagagtatatatatatagggatatatataggggttacgtattgtggacgattatttataagtttaagaattagtaatgttaaatattgtttagggatatgtgtattttatataatatatataagtttaagttcgggatagtggttattttttagggagattgggtaggagattacgggtatttataagtgttttcgggttcgagttggtggttattttagagtggttattttattgttgtgtttcgtaatttttatatgaatacgcggtgtttggtatgtgtaattgttatataatagaaggttttttaataaggagggtagtgaacggtattattggaggtggggagtcgggtagggaaggtaaataaagatattcggtgtttttttatgtgatgaatttcgtttttatatatttgtaagtgttttttgtgatttttttgttatttttattattttacgaaaatggggcgtagacgttgggtattacggtttacgtttgtaattttagtattttgggaggttgaggtgggtggattacgaggttaggagttcgagattagtttggttaatatgatgaaatttcgtttttgttaaaaatataaaaattagttaggtttggtattaggcgtttgtaattttagttatttaggaggttgaggtaggagaattattggaatttaggaggtggaggttgtggtgagttaagattacgttacggtattttagtttgggtaaaagagtgaaatttcgttttaaaaaaaaaaaaaaagaaaaagaaaaagaaaagaaaagaaaatgaggtatagagaacgtaagaattgtgtttgttttagttttatagtgtataaggttggagcgggatgtagaatttatatatttggttttaggttgttttatcgtagagttatatggtttttttttaagttaaaaatgtttagtttttatttggtaggttagtaggtagggtcggggtttttattttgtttagtttttaagtgtttttagtgttatgtcggttgtttttgtttaggtttttttgttacggttttgtgtagggcggtgtttatattagaattttttgtagattgattagtagtatttttatttaatattgacgggtagcgagagtcggtaggaagaatggggtttttaggttggagttggagtgtgtgatcgttattttttggttcgggtaagttatttttatttttttagtttttttatttataaaatgtggataataacgttattcgttttttagggatatgaggattaaatgagtttatggcgtgattaattatattttatatttttattgataatatttggggtggtttttaaggatgggaaagatattttaagatgttgtttattaagtgggaggtaagaataaggtatagtttttattagttcgggtgttaggttagttatgaatttatggggtttttgatataaaaatttagtagtgttgaaggtatatttttagggtttttatataagattgttggaaagtgggttttattattttataattgttttgataggttttagatttttttttagttggagttagtggtgtttaataacgtataggttagagaggtgcggggattttttttttgtgtattttttgatagtttttgttatcggttatttgcggtatttaaggttggttattagggtgtagtagaggtacgtttatagtaaagtcgtcggttcgttttaggtttatttatttttaatttttttaaatttgttttttataaaaagttttttaaatagtaagaattttttgggtagagaggaagagaggaattgtaggtagaggggttaaggggaggtaagttagtttgatattataggcggatattggaaaatatttaggttgtatttagttgggtagttttcgtagggtgggttcggtaggggtggtggtaggggaggagtgtagataggggaaaggttcgtgtgtttttttatatttttttttaggtatgaatttttatttcgagggagtttggtgtagggttggagttgtagattttagagtcgtttttcgttttgggttttttggtaggttttttgtttatagtatttttttaattttgtaaggagggtgggtgcggggagtttcggatatgaaacgagataatttatgtttagttagtggtataggagtgtttgatgttttttggtaattgttattatgattatttttttagagtaatagttttttaaaaagttttgtggtttttgggatagttttttaatttattaaaattttggtatattgtatttattttgtggatgatgaaaattgaggttttggaagattaagagatttgtgttttttgttttattgggttttttagttaagtgtttttttagaataaagtggttttttttgttgtatttttttttgtattttttttttttttattttaatgagaaatgaagggatagagagaggaaggggaaggaaacgttcgggtttatttttttcggggtgttatcgttaggagtgggttgaattgtggttttttaggggtttttatttatttaaagatatggttaaggtttaggttttggaatttatgattgtgattttatttggaaaacgtttttttttatagatttattaaggatttttaaatgggattatttatttagggtaggttttaagtttaaagataggtatttttgtttaaagataagaaggaaagagggtaggttcggtggtttatttttgtaattttagtattttgggaggttaagtaaggtgggtagattatttgaggttaggagtttaagattagtttggttaatatggcgaaattttgtttttattaaaaatataaaaattaagttaggtgggtggtacgtgattgtaattttagatattcgggaggttgaggtaggagaattatttgaatttaggaggtagaggttgtagtgagttgagattgtaatattgtattttagtttgggtgatagaacgagatttcgttttaaataaaaaaaaaaaaaaaaaaaaaggaagaggagggacgggatagagatatagggaagaaggttttgtgataatggggtagagattagagtatgtgatgtttttataatataattaggaatgttaggcgttattagaaggaggaaggtatggatgaggttggtttttagggttttagaaggaaatagtttttgatttcggatttttggtttttggaattgtgaaaatacgtttgtgttgttttaagttttttcgtttgtgttaattggttataatagttatttaagagattaaggtgtgagggttttaggaattttagtagggtaaggggtcgagggtttatttggtttatagagttatagtttattttttttttaggtttagagaggttgggcgatttgtttagggttatataggtgtttatgaaagagtttgtattaggatttagaatttggcggtttttattttagtttttgtttttttgaatttttttttgttcggggggaggtttggggtggaggtatttgtataggttatttgtttttttatttttttaagggttgaatggggataaggagatttttttttttgggtggggtaaggtagtggatgaggttttacgagtttttggtttaggcgtggtttataggttttgggttagtagaagagattgtttttttatttgtttggagtttcggcgtttgcggcgagtattttcgatggtattttatttggttttttttttaaggatttttttgtcgttgatttggtattcgtggttattgtttattatagtaaatgggattattttttggggaacgggtagacggtattggttatatatgtgcgggaaggtaatttttttttttgggttttcgggaggagttgttttgagtttggggttttttaaaaacgagagttttagtttgatagtattgggtatagatatttgggtttagtgttttttggttttaagaatataattttatggtttaaggttttttaaatttttaatttattttttagtaggaattgggggttttttgggaataatattttagtggatttatttattcggaatttttcgtttattagtcggtttttcgagtttttattaaattttttttgggggtatacgtcgatgtcgttggatagtaggtttgcggtgatttgggataaggagggagagagatgggtttatttttgtggtaagttttatttatttattggtgtttgttatatgatttttatattgtgtgttgttttaggttcgggtttaagggtaggttttggggggttgtgatattaattatttttaatttttgtgttttttggagggaagaggggtagttgtaggtgtatttgttgttttgagcgacgttgtaattttttaggggtttaaggttatcgttttgagtattttttatttttttttttttgtttattatagttttaagaaagtatttagggttatcgagatttttttttttgaaattttttttaaaaaattttcgttatagtttttagttttagtaggggtttcgtttgtagtaattttttagttttttgttagtagttcgatatgggtacgtgtaatagaaatattttagtgagcggttgttcgtttgtttaggtatagattatagttcgtgtgtagttttcggtagatatatttattttgtgtggattgtttttttttgtatatgttgggaaggtttttgatatttggttttaggacggagtaggttataggttttatttatatttatcgaggtagatgtggtgtcgtagtttaggtatttcggttttattttgaaaggtattttatgtggttttgatgtgttgttttgttaggaggaagagtttagggttgtttttttgtttggatgtttttttttattttatagtaggggttttagacggtggcggagaagaaggtggtagagattattttttttgaaatttttttttttttttttttttttgagatggagtttcgttttgttatttaggttggagtgtagtggtttaatttcggtttattgaagttttcgtttttcgggtttaagagatttttttgttttagttttttaagtagttgggattataggcgttcgttattatgttcgattaatatttttgtatttttagtagagatggggttttattatgttggttttaaatttttgattttaagtgatttgttcgtttcggttttttaaagtgttgggattataggcgtgagttattatatttggtttagttttttttttatttaataaaaattaggtagggcgaggtgaggtggtttatgtttgtaattttagtattttgggaggttgaggtaggaggattttttgagtttaagggttagagattagtttgggtaatatggtaaaatttcgtttttattaaaaatataaaaattagttagatatggtggtgtgcgtttgtaattttagttattcggggattgagtttgggaggtggaggttgtagtgagttatgattgtgttattatattgtaattttggtaattgagttagatttttttttaaaaaaaaaaagggggggtataaaataaggtgggttatgtcgtacggtttttgttcggttttattttttggaagagagatttattatttgtttggtttaggttttttttaaaattttttttagagattttgttggagaattggtatttttataaagttgtttttgagatatgggggagttggagaggttattttagggacggtttttagtagttatttgggttagggattattaggttagttattcgttggggagagtgattagcggttcggtttttttgatagtgtgatttttttagacggggtggtttttgttaggtttgtagcgtttttaggttgtatagaagggttggggtaagtagagatggaattttattcgttgtttgaagtggatttttttttttagggtgagtgtgttcgttttggcgatgatagggacgatgttgattattttgtttaggcgttttataaattcgatgtttaggggtttgaggttgaagtagagggatgtgcgtgaggtttatttgggggagcggggtagtgggggggtatttatttttaagtaggtgtcgatatttttaggtgttggttcggggtttacgggggtttttgttggtaaggatagggtttcgggtcgagtcggttacgttgtgagtgtggggtagaggaaggatacgggtgtgttttagatataggtgatattattgtataggttaggcgggttagggttagttttaagtattttcgtttatgagttttggggttttaattatatttttatatgtttatatagaagggttgtcgttggtttagtagtcgttttgttgtggggttttggttgggaggggagaggtaagagaaatagaagttagtattagtgtgcggtgtttttgtattaggcgggttgtttttttgtattaggcgggttgttttttttgtttgtttggttttagtgagtttggggtttgatgtggggaaagttgtgggtggtaggggttggtagggttttggaattggggtattattttttttagttttggagtcgagttttttttatagtgagaataaatcggttatatatatggttggggagaagttcgtttcgggtagaagtttaagtagagatggttaaggttcgtttttgttttatgggattggacgttttgggcgggattaggtaatatgtttagttggagttttagttaaagggttagtgttggggagtggtagaagtgttatagatcgttcgttcgttttcggtttgtttagttggtattaggagaggtttttgttttttgttattagttttagttgaggtaaagtttggagtagttggaatagttgttataggatcgtaggtgagtcgttttgtttgggagggtagatgtttagtttaggagaggtttatggatagcgggttggttttttgtttttgatttttgttggtttatagaggatgatgttagagggtgggttcgaaaatttcggtttgggtttttttatagattttgggtgaggttcgttgtttattagttaggtttttttttgtatttggtgtttatagagtatggtttttttaaatttttgggtttttttcgtttagggaagtatatttgggatagtaggtgcgaaggattttttttatttatttatgtagataagttatttacggttgtttttattagttatttttgttggtttttggtttttttttttttagttttggtttagggtgagttataggtgtttggtagggggtgtatagggagttgaggatagagggttcgtgaggttatgaagagtttatttgttagggtatatgtagtttttcgtttttgttgatttttaggggcgacgttaggtgcggatagagtcggcgggaggaaagggtttttattaatattaatagtagtttcgtttagttttggaaggggttagtattgatttttgtgtttttcgtttaagaacgtattaaattttttaaggggttttatgaggtagggttcggatgagaaggttagttatcgttacgggtgtttggttgggggtttttattttatttgttagagtttggtttgagaaggtaggatatagattattaggttttagaatagtttagggtttgtttgatttttagttttttaagacgtagttgaaggatgggggttgggtaggatatttgtataggggttagtgtgaggttttggaggtgtagatatggtatatttttaattttatagttggcggttatggtttttgatttagtttttttgtatttagtagtagggtagatagtatcgttttgtagttttaggggatagagggaatttagggtattcggtatgaggacgtcgatattgtagggacgtacgagtggtcggtggcggggatgaagtagaggtagtagtggacgcgggtgttcgggatgcgttttttgcggttgatgttgatttttttttgtaggtatttttcgtattggttattgatgaattttatgatgggttgttagttgcgtgggggatggggacgagttagtaggtatatgagatgttttttttaagtaggtcgtgtatttttaggatttagagtttaatattttattttttaatgaaatgtatgttttgggaggtttggtttgttgagcggagatgttatagttttattttcggttttttaaattagttttttcgggttggttttaggtgatgagttggggatagtaagattttttaggtaattttgttttggtttagaatttttaggtttttgagacgtgcggttttggtagtatgttaggttttaggaggtgggttttgtattttcgcgggtcgggaaatttttagggttgattttgggtggggtttagggagttttgaagttttcgttagtgtttttttttttggaggggttttattagttttcgttgttgatgtggttttcgaattttggtgtgttaattattgttagttttattcggacgtttttttttttaatatttgtatagagttacggacgtagagttagaggggagacggaagatttttatagatattttatatttgattgatttcggggtaattttaggtaggtagcgatgataattaaggagatatcgggaaattaatggttttttttagttaatttcggtataggtcggtgacggtttttttgggagttttttgtttgttagatttttggtggaaaatttagttgtttgtggggagtttagtgtgacggggtttataggggttcgggatattgatttattatagttagagttttaatatgtttaatatgttggggatggtgggtatagcgagttttcgttttggggatttgggattgtttgattcgggtatttttatatcgtattagtgttttaggaaggtatgggtattttatatttttagtttatttttagttattgatcgtgtgtgatggttttgatttttaatttttgtgttttaggaaggtaggggcgttttgtatttttagtttattttcggttattgattgtgtgtgatggttttgattttttattttgtgttttaggaaggtagaggagttttgtatttttagttcgtttttggttattgattgtgtgtgatggttttgatttttaatttttgtgttttaggaaggtaggggcgttttgtatttttagtttattttcggttattgatcgtgcgtgatggatttgatttcgatggttttggggatgcgtttttttgaggtgggttgtatcgattttcggttgattttggatttgaagagggtgttgattaaggtggatttatttaagtcgttttgttttggggagaggatgggaggtcggttaggggttttttcggagagattagtagggtttgtatatggggttttttttatttaggtacgaggttttttagtttgagatttagtagtgtttgggttatttttcggtaatatttttgttaagtagttttcgaggattttattttcgagtcgggtgtttagtgattgtgtaaatttatatagtcgggttttgatgttagtataatttaggttatagtttttttttgagaggtgagtcgggtttgggagagtcggtattttttgtgttttttgtgttttttggataggaggttttttggtggtttagattttggataggatagaggtcgggttggcggaggagtttagggttgtttagggtgtattaggtggtcgggatttttgtagtttattagggtggttgtaattaaagtttaggtgtttaaattgtttttttttgatcggttagggtttgggtaagttatttgattttatcgtgttttagttttttgatttgtaaaatgggataaatagtttttttttcgtggagttggtgtgagtattaggtaggtttacgtatgttttatggggtttgtggggttatgtgttagggggcgttggtttgtagggtggtgttattcgagggatagtgatcgtgtgtgtagatagttagtttataggtgattgagataaacgaggatgaggaagtagtatttatatgtaatataatatatataatttatatatattttatatatatattttataatatatatattttatatgtataatttataatatatatataatttattttaaatatattttttatatatattttatatataatttttataatatatataaataaattatatataatacgcgcgcgcgtgcgcgtatatatatatatatatatatatatatatatatatttttttagattcggagttttattgttttattttgtatagagttgttttgggttacgttagtaatatattaaaaaaaatattttaggttaggtgtggtggtttatgtttgtagttttagtattttgggaggttgaggtaggaggattgtttgagtttaggagtttaagattagtttgggtaatatagagagattttgtttttatattaaaatgtaaatattggttaggtgtagtggcgagtatttatagttttagttacgtaggaggttgaagtaggagaattgtttaagtttaggagtgcgaggttgtagtgagttaggattattgttattttagagtgatagagattttgttttttaaaaaaataaaaatcggttaggcgagatggtttacgtttgtaattttagtattttgggaggttgaggagggtggattatttgaggttaggagttcgagattagtttggttaatatggtgaaattttgtttttattaaaaaatataaaaattagttaggtatggtggtatatgtttgaggtacgagaattatttgaatttaggatgtggaggttgtagtgagttaagattatgttattgtattttagtttgggtaataatgagattttgttttaaaaaaatataatataaaaaatattttaaattatattgatgttttgattttgataatatttttttaggaaaagtgtgggtttttgggaggatagaggttggtgttgggaatttttggtttgaattgtttagtagtttaaggacggatatttttcgtttatttttttttgtttattaggtttgtgttttggttaattttaggttaggagttatgttaatgttttagttacgatattttagatttaggagatgttaattgggatattgtaaggtgtatttttttattattgttatttttattattattattattattattattatttttattattattattatttttattagtattattattataatattattattgttattattattattttattattttcgttattattattattttcgttatttttattattattattattgttattataattattagtattagtattattattaattatattattattattattttattattattattattaatattattattatttttattattattattattattattaatattattatttttattaatattattattatttatattattattataattattattattataattattattattattttttttattattattataattattattattattattattattataattattattatttatattattattattatttttattataattattattattatttatattattattattatttatattattataattattattattatttttttattattattattattattattattataattattattattattttttttattattattataattattattattattttttttattattattataattattattattattttttttattattataattattagtattatttttattattattattataattattattattattattattattattattattattataattataattattataattattattatttatattattattattataattattatcgttattattattataattattattattatttatattattattattataattattattattatttatattattattattataattattattattattattataattattattattatttatattattattattataattattattattatttatattattattattataattattattattatttttattataattattattattatttttattattattattattattattattataattattattattataattattattattataattattattattattattattattattattattattataattattattattattattattataattattattattattattattattattattattattataattattattattattattattattattattattatttatattattattattattttattattgttattattattattattattatttttattatttttatgattattattattattatttttattattattattattattattataattattattatttatattattattattattttattattattattattattattattattatttttattatttttattagtattattattttattattattatcgttattattatttttattatttttattattataattattattattattgttgtaaattttcgaataattataatttgttggggattttgttcggggtttagttcgtttgattttattttatgggatgattttattttatggacgaggaagttaaggtttatagaggaggagtttaggggaagatatataagttttatttcgttgagttaggataaagttgggatttttttcggggtttgtggatttttaaataggtgtttttttattttgtttgtatttttgtaggtgggtatagttgttatgggagggaggagggaggagagtagagttgttttacgttttgttttttattcggtatttttgggagggagtgattttgtggggaattaggattattgttttttttagggttgaaagggcgaagaggtttagataggtgaagtggttttttgcgtattatttttagagggtaaggttgttatagtggtagttacggaaggcgagggttgttgggttgtttttttttttttttggggttaaagtttcggaagaaggtttgtgttatggttgggacgtagaggtttttaggttttttttattttgtttttggttagggagtagggtagttttttcgtagtttatagagatgagttttagtttggttattgtttttgggttttttttttttttttttttttagttattttttcgggaggtagttttgaatttttagggtataagtacgttttttataataggtagaatagggtgggggtcgtaggaggggattttatattttcgtttttttttgaagtaggttgttagtttttaggtagttgtgagtatagtagggttatgagtagtcgggttttatgaggttataggaagtagagaggatattaagattttaggggagttagggtttagattagtgtagaagaggaaagaaaggtgtcgggttggtaggtgtgggtttgcgtttatagagttgggtaggaaggacgtgtacggttggtaaaggttagagaaataggttcggtttgagaggtgtttagatattttgtagaaatttcgtaagtttatttttgtttagggtgtgatttggcgggggtatttttttagatttttttttggatttcgtggagtgggtagaatatagttttgggagttaaaacggtggttgcggttttttgttttgtgagttaaggaattttggtagttttttttgagtttcgtttttgtttggaaaacgggacgttttttttatagggtttttgtgaggtttgaatgggatttggggggttttggaaataataggcggtttattgtagattttagtttggtttttttattttgtttaggtcgtgttgatcgacgatttttcgtggtgatttttagtttttcggggttattagggggtgtggaagttacgaggttttaattttagggtagagttgaagttgagttgttgggaagtttttggtcggggtgcggtggggtgcggtggggagtttggagggttaggttggagtaatagtgaggggatagttgttatagaattttttgtataagttgacgttattgtttagaggtagcgattatttattaggatttgttttaggtcggtttgggttttttaaagttattttaggggttttggatgtgtaggataggtttttttgaggagtcgttggaggttgtgggttttttttaggcgtatgtatgtatacgtaatgttattggtaattcgtttttgaggttagggttgttgttttattttatagaagggaagattaagtttaaaggtttgtgggtcgttttgggggttgaggttggttttcggtattggttgagtggtatgtaaggtgaggatttatcgattattatgatgttgaattcgaagttttgttttatggtttttcggcgtatttgttttaggatggagttaatttttacgtagtcgaagtttatcggggttttttcgtttcgtgatgtaggcgtttgtttgagttcggtatttttgggggtgtcggttatgtcgttaacgtagttgggagtcgttttagtggttggggaaggaatagtagaggagttagagcggaataggggtttatatataggcgtttgttaggtggttgttatatttatttttggatggggaaattgaggtattgaggtttagaaaggttaagcgatttgtttaggcgatttttgagaattttttcgggtggatgtttttggtcgtggtgttttttaaaaagttgttattttgtagttacgttgtttttttagtaaagttttatttttagatttttaaggttaggtttttttatttttttttttaggagttgtgttaagttgggggttttttgcgttttaaggtagggttgattttgaatttttgttttcgtattttggagggttgtttagataagggtggagggtgttttttttttttggttttttatattgtttcgggttatttaggtggatttggtttttttttttatttttatttagataagttgtatcgtttgttgttatttaaaggttttagaagtcgatttacgagttaagatataggagggatggttttgtaagaaacggggatagaattagcgtgtgttttcgttttttatatttttatggatggttttgtaagaaagggggatagaattagcgtcggtttttatggagttgtgtgtttaattttatagaacgagttagtagttttgggagaaggaaaagtgttgggtgtagggcgggtgtttggatgtagagttgtttttgggtttatggaggaggggggtttttgtattatatttgtttttttttggattgatttaggcggtcgttttgtgtgtttggttagcgtttacgggttgtatatttataggttaagattaagttttatttttgggtatgtggggtacgtggagttgaatttttcgaaattattaaagttttttttgtttgtaggttttttcgatggttttgtttttggttgttgttaagatattatatacgggttagaggtttggggttgggggcggacgttcggaagacgtttgttgaggatttaggtgtttttatatagtggggttttaggggtatttaggatggggttggtttttattagggttggttggtatacgggttaggttttagtatattttagattcgttatatttattggtgtatgcgtatgtaggtgtagataattcgttggttatagaggtggtgtttttgttagtttttataggttggagttgtttttggtggtttttagtttttacgtaggttgggcggttgttgttttgtgttttcgtttttgtttgggtttatttaggttttgttttgtttgcggggagatttttgttttattttgttttttagggaggatttggttttaggtattttgcgttaagatagggattatacggtacgtttttaggtagggtttttttcgttagtttttcgggaggggagtggtttttttttgggatcggtgggtatttagtaggggtagttataggggagtggagtcggcgtgggagttagggttatagtacgggaggttgtagggggtttatttttcgtgataggtaagtgagtagtttttttagataggaggtagttttttcggtttacgtttattttttattttgtttagaaggtgggaggtaggtttttaggttaggaggggtagtgggagattttagtttaattgtttttttatttgcggggtaagaatcgaatttaggaaatgtttattgagttttttggttgtagtttgtatttttagtcgatttaagttatttttttcggtttattttattggagcggttagagggtgtcggagggaggttttttaggtttgaggtattagaggtgagagaggaaaagattttggaagttagaaattgggggttggtttatttttataggtattttttcgtttttttagtttttatagggtataggaatttttattttatggaattgggggaataaaggaataatataattttttgttgggaaatgttaagggggggtttatatatttttattgttgagagtaatatttataggcggatttggaggttagggtttttttttttgtgtttttacgtggtttttatttaggttacgtagtttggaagtttttagggttttgtttttgtttttgttttttttttagaaatatttttttttgggtttttaggatttttaaataaataaagatatagttttgtatttggttatggattatgtggttttggggtcgttttttgaagttagatatggggttttgttttgcggggtagtagtttagtttttatttacgtgatcgaaaatcgtttttatttgtttgtgggtttgagagttattttgtttgggattgggattagtttttattcgtttttatttttttttagtattttttaattttttttagtaggatttggggggaggcgttgttttttgaatttttttttttcgtttttaacgtttttggagtttagagcgagggaggggtcggtttagttgtagttgggtttttttataggtattagtatttattgtagaaatttaaattaaattaaatattttgtttattaggggtttcgtttgagaaataataatataacgtagtcgagttttatttttgttattgacgtagggtagtggtttgttttttgtataggtgagagttatttttgtaatttttttttcgagaggcggttttgtaggtttcggttggttcgtaggtaggtacgtacgtagagagtaatgtaagagttcgtttcgtttttttatttggttaggtgagttttggggtttgtttttaggatttttaagtgggaaaagtagagatttttatatttagagatatttttattttggttttaggatattatggtgtttagatagttggaaataatggtaaagattatttattttattgtttgtgattacgatatcgttcgaggtttgcgttgtttagcgtggtagttattggttacgtgatttttttttttaattgttataacgtttgttacggttattattttgaagtgtgtagtttagtggtgttaagtatattcgtattgttgtgtaataaatttttagaatttttttattttgtaaaataaattgtttttattaaataattttttagttttattttttaagtttttggtaatttttattttgttgtttttttgaatttgattattttacggatttggtataagtggaattttataggattgtttttttgtgattaaattattttatttagcgtaatattcgaaaggtttatttttgttgttgtaggtattttaattttttttttacggttgagttaaattttttgtatgttttattttttttttttttttttttagatagagttttgtttttgttgtttaggttggagtgtaatggcgcgatttcggtttatcgaaatttttgtttttttaggtttaagtaatttttttgttttagttttttaagtagttgggattataggtattcgttattatgttcggttaattttgttttagtagagacggggtttttttatgttggttaggttggttttgaatttgtgattttagatgatttattcgtttcggttttttaaagtgttgagattataggcgtgagttattacgttcggtttgtttcgtttttgatttttttatttatttgatcgcgggtattcgggttgtttttattcgttggttattgtgaatagagtcgttatgaatgtgggtgtataaatatttttagttttttaagatgttgtgtatttttttgaatttatatttagaagtggaattatgggatgttacggtggttttagttttcgttttttgaggaattgttatagtgtgtttataagtgatttttgagtatttgatattgagttagtttaattgaggaacggaatttttatttttatttaaatttaaatagttatattttataaatggtaattatattggatggtatagaattttagtttaatttattttttattaatggggaaattgaggtttatagagtgatttttttttttgaaatgttattgtaagtggttaggttagtataagatttttattgaatttggtaattttgaaattttatatttttgtttgtatgatatgcggttaatatttgtgattttttttaaagatcgtgggttttagtaagacggtagttgtttcgttgagatttttatcgtatttttaggtttcgttttgttacgaatacggttgtgtaaggatttgtttgggtttttgttttttattttttcgggtatttagattaattattagtagtatttacgtcgatttttagaaaggttttgatttggatagtaattgatacgttattttatagttaaagtaaaatgtagagtttttttttcggtttcgtagttgggagttagaggttttaggttttggtttttggtttaaagtgattttttgtaagtttttttagtttggtaaataggttatgtattttttgattttttttttagtttttgttttgcgagtttttgggtgttcgaggttgtggtttatttagtgatatttttagtttttagtgtagttcgtgagtagtataatatattcggttttagaaataattaatatattcgttaatagatgcgtggagaaatttaacgtgttgagttaatatagcggattattttttagttataaaaaggtacgagcgtgcgttaatatagatgaattttgaaaatattttaattgtaagaaattaagtataaaaagttatattttttagggttttagttatatgtttagaataagtatatttgtagggataaagcgtagattggtgatttttaggggttgggggagggggagtgattgtgtatcgaggatggcgtttttttttggggtgaggaaaacgttttggaattagaggtgatgtttatagaaggttgtgaaaaaatgttatttaattgtgttttttgaatcggcggatggtgtaatatggaaattatatttttatgaggacgggagaggaagggaaagaagggaaggagggagggggaaggaaatagggaaggaaggaaaaaagggaggggaggagggagggacggaagaagggaaagaaggtagttatttttagtggagttggattgaagagtttaatgggtgtagtaaattattatggtatttgtatttttatgtaataaatttgtacgttttgtatatgtattttagaatgtaaagtaaaataaaataaagagtttagtgttttttataagtgtttaggagttagttttatagtttagaggatagttgaggtttagaggttaatatttaggtttgaggtttttaagttggtgtcgttagattatgttttagataaatttttttatttttttgtagtaagggtgtttttagggtggtagttaggcggaggtgttaggtggcgggagattttgatagtttttttgtaggtttttattttgaatttaggttttatgttagggtttttttgttatttattggcgttggtggtagtaggttatcggtttcgtgatggggattgtttttaaatttgtttattttggggattagttttttttttttcgtaggcgtttattgggttattttttttttagagttgtaggtgggtttaaggtagggatgaaagggttgtaatttacgtagttttgagttagtattttttgggaatatttgtatttagtgataaatttttattttaattttaggatttgtcgaggatgagggaattagattgttgtttgtggttgggacgggggttgtaggatatttggttgggaggtagtgtttagagaggaggtagttattggatatgatatattttaggggtatttatatttattatagttttagggttgattttggtttatttggtttggtgtcgagagagggtttgatatagtaggtttgtaaagtttgatttggaaattaagatttaggggtcgtttttttttgtttatttttttttgtgtgttatgttgtttggtttacgttttagaaatgtttatataagttttattagttttgttggttaaatgtagagatggtgtcgttggggtaagggattttgagttatcgtttaatgttatttttagttttaggggagtgatagtcgggtttgtattttaggataaagtgtttagggttaagttaatgttatttttttgttttttttaaatttaatttatatttggtttttagagtacggatcgaaatggttatatttttatatattttgtttgttattgttaatggtggttaagtagaatgtaaggttattttttttttgtttacggaggtttgtgaagttattgattaggttacggtaggggagtcggtggtatttattatattttgttagttttttaggttcgtgtttaggagaaagttgtcggtatttatagttggtgtttttgtttcggcgaagatttttttgtttttatttatttcggtttagcgtgggtttagtagtttttttattttgtttcgtaataatgtatattggagtagtttttagttgttttttttttgtaggtttttttgaatttagattttggggttagtatttttgcggtagttttacggttatttgtaggtttttttagaaatttgagtttatgggggtattttaggttttataaattaatagatgttttttgttttttataaaggggttttttaaagttgagtgagtttttgatgtaggtaatgttaggaggatagtgttcggttagggttgtttttttttttttttttatttttttgggtgtttgtaaagttttttagatttttgttgaattttggggaagttttgtttcgtaattagggtttgtttttttcgtttttatatagagtttgttttttgcgtttagatagtttttttacgatggtaattgaataatgatgtgtgcggtttttttttattataatttttttatatagggtttgtgaagttagatattttatttattacgtttattttagttcggttttttttagagtagcgtagggtttacggtaagtttcggtaaaaagtttggtgaatgaatgaataaatgaagaaataaagtttattatagtagtcgaggtttattgggggttttttgtgttaggcgttattttaatttttttttttagagagtgggttttattaatgttggttaggttggttttaaatttttggttttaagcgatttttttattttggttttttaaagtgttgggattatagatataagttattgtatcgagttttaggtgttattttaaacgttgtttaggagttattataattgatggattattatataattttataaggtagttattgttattgttttattttatagataaggaaatcgagatcgagagggtttttgttaattatgagggtcgtaaagcgagtaagcggtagagttaggatttgaagttaggtaggtgagttttaggttgttgattttttttttaggttaggttttcgggaattatggaaaggttggagaagtatggggtttttgtagttaggatttagaaggtgtagttgcggtgtaggtagtttagtattgaggttttggtttttagttttttttttagttgtttttttttagggagttggaggtagagttttgaattgttaggagaagattttattcgttagttagggaaagttgttagggttttttttagggtttagagttattttaggtttattaaagtatattagtattttagtttttataattttttttgtaagaaagatgatggtattagttattgggtcgggttgggggttttagattttaggggtttttttaggtttgtttatggtttttttaggatatagatgtttatttgagaaattttagtgtattaggggttttatagttaaaataaagaggtagagttgttttggggtttttgttaaagtttttaggtagatttatttagtagatattaaaatgtttattttttatttgaaaattttatttttaggaggtcgttttaggttgggttgataaaatttatagagattttaatgatgattttttattttaggtatgagtgagtgggtggagggagaagttattgttaattattaatagtttaggaaatgtaggtaaaggaaagagaatggtaaggcgatagggttggaaattagatatacgtgtagaggtgagtagattttagagaaagaattgttttggaataagatggtaaagaaattatagataataatggtagacgatgattttggggttttagtggattaggattataatattgatttatttgataagtatttattgagtgtttattttatagtaataaaaagatgatattataggtttgagagtagttagaatgaaaatagtggtggtatatgggaatttgaagtttatttatttaaatgtttattagtcgagattttcggatagatttgaagtagtttttaatatgtaaggaatttataatttgatatagtagtataggatatgtgtgtgttataaatttttggtgaaaagtaaagattttttttagaaaagtatatattgaagatagatagatagatatatacgtattttgaacggtttattaaagaatttttaggttcgtggattttagttaaaaaaataatttggtattttgggaggtcgaggcgggaggatcgtttgagtttaggagtttaagattagtttgggtaacgtagcgagattttatttttataaaatgaaataaaataaaatgagaattaaaaaaaataaataaatttggtgtgatgagaatttatagaatttaatagggttattttagtattatttgtagtattttttaaatttttgattatatatataaagttttgggttttatagttagagaagagggagagtaggttaaaaataattatttaaggtggaagatgagtttgagaaataaagaggtaagaggagaagattgaggttagttgttttttatttttgagtttcggtaggaggaagtttttaagtgagaataagttgttgtttgcggagtggattttagagcgggtggatagagacgataaggaatgttatttttggggggttttgaaaataggatatttttttattttaattttgttttttattgtattgtgtttttattgatttatttaagttattataaatattttataaatgttattggggattttttgtttttttttaaagatggaaatattgaatataaatgattaaattgtgtaaatgtgtgtgggtgggggattaaggattgaatttttaaaatgtatatagtttatttaatttgttaattaattttaaattaaattatattttatattttgtatgggataggaagcgtttttttaaagtttggttaggatttgggatgtcggaaatttgagattttgttttttttttttgagatattttgaaattttgtttagaaatcgagtataatggttttggttttttagagaaagatacggatttgtaaaggtaaagagttgtattttttttcgagttggagtttttttcggtttttattatggggtttaaataaaattgtagttttatagtttttttgttggtgtttttttttttttggtgattaataaggtggaagagttaataagaattttgtgtgtttttttgtaggatttggaagggataggtggtgtgagtttgtttttatttagtttttttttttatttatttaggggtcgaggcgttttcgaggtagggggcgggggtttttatttttattgtcggttaaggtttttttagtttttttttcgttaaatttttttaagtaaattttttttttattgtggaggaaggaattttaagtagttttgtttttttgttagtacggttttaattggttttagtcggtaaagttaaatttggataaggtttaagggttttttatattattcgtcgttttttggaagaggtttttttttgtttttttatttgtaatttattatttttttagtttgagtttttttatttaggtttcgcggtttattgagatattaattttgggttagagtaagttttgatttgtaaattattattatttattttttaaagagttatttttagaatttaggttgtagggagggtaggttaaggatgaattttttgatttttggtgcggtgtgtggtggggggggttattttatattttgttttttgttgtttttttgttttgttttaggttttgaagtggatttattgtagagggagggttagggaatggttttgatgttttttttattttaaggaattttttagtaggagcggtttttattttaaagtaattttaagatttagttcgtgttagttttttagttatgtttatagtggtttgttaattagagatttttttagtttttggtaaatttgtaaatttataaagagaaagaaaagttttttcgtgggtgggtggatattggttatttgttataggttggaatttttttttattagggatgttttttaagtaggggttggggagggtagggtttagagtttttttttttttagttttttttgttattagtagatttgttagtagatatatagtagagtttagtagtgaggtaataataggggttgtgggggttggggtttcgttttttttaatttatgaaattatttgaaataataaaatttagataagggtttttggggtgtaatagggtggttttttgttaggtgttgggtagaaaaaaagtttttttttaatttttttttgttgtgtagattagttcgggttttggggatgttgtagaggttgttttatgtttaggttttttagagatagtagggggttggaggtacggtttgtttgggggtaggggataggtagggaggggtatatttttgggttatgagtaggagtttgattaaatgatttttttaggagggagaaagatatcgtatataattgtttgattatagttagaggggttggaaaggtgggggaaaggggtgaaggggttaattgttttaggtgtttttaatttatgtagtatttatttggattgataagagttgagagattggaattgtttttttttttcgtttttaggttttgttttaggagtttttttgtttaggagtttgggagttgaggaggtttggaagtagtgggtttatagtgttatcgttttgggaatttatagtgttttggatgtggttttttcggttttagttttgtaggtagtttatttggattgtatttattttttagaagagttgtttagaattttgtatgttcgaaagaaagattaattaaagaagtgaggaagttaaagagaggtttatgaaagtttatgacgtattttttaagtgtatattttagtaattttaaatgttttttgaagtaaggatggggatggatggttggataaatggatgggtgtatgggtgtgtgaatgggtgagtgggtgggtggatggatggatagatggatgaatggatgggtaggtggatgaataggtaggtgaatggatgggttggcggatgaatgagtaaatggatgaatgattggatggatgggtggatgagtagataggtggatgagtgaattggtggatgagtggatagatggatgagtggatgagtagatgagtgaatgggtggatgagtggatgggtgggtgagtggatgagtagataagtggatgggtggatgagtggatgggtagatggatgggtgagtggatgcgtggatgagtggatggacggatgagtggatggatggataagtggatgggtagatgagtggatggatagatgagaggatgggtagatggatgggtgagtggatgggtgggtgagtagatgggtggataagtggatggatagatgagtggatgggtggatgagtggatggatatatgggtggatagatgggtgagtggacggatgatgagtggatgggtggatgagtggatggttgagtggatggataaatgggtgaatgagtggatgggtagatgagtggatggatagatgagtgaatgagtggatgggtggatgagtggatggatagatgggtgaatgagtggatgggtggatgagtgaatgagtgaatgagtggataggtggatgagtggatgggtggatgagtgtatagatagatgggtggatgggtggatgagtggatgggtgggtgagtggatgggtaggtggatgagtggatggatagatgggtaaatgagtggatgggtggatgagtgaatgattgtagataggtggatgagtggatgggtgaatgagtggatagatgggttgataggtggatgagtggatgggtggatgggtgggtgcgtggatgggtgagtgagtggatgggtgggtgggtggtaagatgggtggataggtatatggagtttatttaaggagttttagaaatatatatatatttttttattttagattttttttaggaaaaagtagtgtgtatggatcgttatttggttatattttgagatagttatttttattttttttggaatatcgtttggggggatgtagtatagggtatttaagtaatttttgagtttagggtagagatattaggaagtagtaggtaggtcgtgatttcgtaggtttgttttatggtttttgttgtttgtattatggtatgaagtttagatgtatttttggatttggggttttgattagatggagttattaattttttgaagaatgaaatatataggggttatttttgttttttagttgtagggaatgacgattatttagttttttttttttttaaattttttttaggtttttgtgtatggttttgttgattttttttttgtttttggttatttttttagtttttgtcgttttttttttcgtttttatttacggagttagttttggtgttttgagagtttttttttttagttgattttatttagtttttgagtatttaatgttaataatgttattttttttgtttagatttatatttgagtgttagtttgatttatagacgtgtttttgggtttcgttgtgttaggttttttgttgggttttgggtatttgtagttattgttattgttaagttttaatatttgaaggtattttgaatttaatgatcgtgttttaggttgaattttggagtttttattttatttgttttttattttattttttatttaagtgaatagtttttttagttaatagttattgtagttagatttttaggggtcgggtttgggttttttatttttattatttcgaatttatttatttattttaaatttttattaatgttaatttaatatattttatagttattattattagttgtttttgttcgaattttttttttttaaagtattagggggcgtgtgtaaaatttattaatttgatgatttttttttatgaagtcgtgattggtttttattgtatttgggatatattagatttttgtggttttagaattttgtttattatcgacgtgttgtgtgattttgagtaagtaatttaattattttgtgttttaatgtttttatatgtgaaatgggataataatatttgttttataagaatgttggggattaaatgagatatttatttatgaagtatatagtgttgtgtttggttagtaaatgtttgaagtttttgttaataaaatatacgtttttaatttattttttagtttttatttacgtatagtttttttggttgttttttagtttttttaataaggttatttatagaggttttttttgtcgggattattttttttttatgttgtttttagaatttttatttgttttttcgggatagtttatttatattgggttttttagtttttgttttgttttgttttgttttgttttttttgagatggagttttattttgtcgtttaggttggagtgtagtggtattatttgggtttattgtaagttttgtttttcgggtttacgttatttttttgttttagttttttgagtagttgggattataggcgttcgttattacgttcggttaattttttatatttttagtagaaacggggttttatcgtgttagttaggatggtttcgattttttgatttcgtaattcgttcgtttttgttttttaaagtgttgagattataggtttgagatattacgtttagtttaggttttttagtttttatatacgtggtttttcgattgttgtttggggtttgtcgtatttattatttataaaattttatacgttcgaagtatttagtaagacgttgtgaatgagtgaatgaataaatgaatgaatggttagtttgttgttttttcgttcggtttttcgttttttttagattagtatgggggtagttacggttttcgtttatttcggtaatatcgttttttttgtgtcggtcgcgttggttagagtttttttttacggcgttttcgcggtttcggtgtgtggtcgtttgtgaatgagatttatgattttcggtttttattatttttttggagttataaagtattaaggcggaaggatggatgggttttttgggatagtcggggtgggaggtcggtttaggaaattttttttaggaaatggttagtgtgggatgaggcgttcggtgggaggggagtggagtggggatttggggtttggttgttttgtagttagggattttaatttttattttttttttcgtttattttttaattttagtgttgggtttagggtttttggggttttttttaggaatatagaagatatagtaaggattagggatataggataggtagagtttatgggtaggaggtttttagttagtatatttgagtttatgtttggttttaattagatattgagattttggttaggttattttttacgttgaggtaggggggttttttagaggttattggtttttaagtatcgcgtggaagatatgttacggagagttagtattttttgagatattagtagaaggttagacgtttcgcggtttaaggatgatttggttttagcgtttatttatttgtcgttttgtatgaaaagtttgacgtgatatggtcggttttagcggaagagtgattcgggaatcggtagagcggatttagtaattggtaaattggatttagtaattgagatattgttaggggtttggtagaagttttttaatgtattagatttagttttgatttttatagagtttagtcgagtattaaaaggtgtagaggtcgagttgagtattaggggaatattgattttagggttgatcggtgttgtgcgtgtattttatagtttatagacggtttatatttattcgatcgtatttgatttttttttgcgaggttttttttagatttttcgttttttaaagttattagttgtgttttttgaaattagagtaaagtaataaaattgtagtaatagcgtgtttttatgaacgttgtgatgttagttggttaaatgagggagtttttagggttttttatattgtttcgattttgtgtgttttttggttttggtttattttttatattttttgttttttttttttttttttttttcgaggatttagggtttggggttgatttattgtgggattttaacggtgattttttggaagaaatgttcgttttttttttttatttagtagtgatttttggttcgtttacgtttacgtagttaatataggtagtagtcggaatttggaagtttttggggtgggagtttgtttttttttaggtttttttagttcgaatttcgggaaggagttatatttatatggtaattttttttaaggttgggagggggaaggggtttggttcgggtttgattatttttttgaggttgcgtttattgggttttttaagttagttgggtttttcggttgtatttttgagggatggtaatagattatagtgtaaattgtttatcggttggttgggtagtgggtgtttagatgcgggttagggttttcgttttataggttgtgtggtggtttaaagtgggtatttttatgggtatatatttgtgttatagtttattcgtgtgtgtgtgtgtgtgtgtgtgtgtgtgtgtgtgtgtgtgtgtgtgtgtgtgatagtttagaaatatggtaatttatagtttttttaagacgttggttttgggagatttgtttatttgggggttttagtatttttagttttttttaggaaggttttgttttttttggtttgaagttggttttagggaagaatttttttagaaaaataaaagttattttttttagttttagtttagtttttttttaggggtgagttatattaaatttattttttttttttttttttatttttttttttacgttgtaattagttgtaagtggtttatttatttaggtttgttagtttattatagaaaagatattcgaattttgtattttttttttttgatttgttttgggttttaataggtaaaggaaattggaagttagtagttaggatttagttgtaggttttcggggttattttgcgtttttattttagttttatttatttttgcgttgatttaatgtttatttattttagtttatggagcgaggtttggatttaagataaaataaagggggttttggttttttggggtttatagtgttcggtgtcggcgagataattttagagtatagtatagagaaatggttgcgatacggattcgtagtatttggttggttaagtatagtaatgtatttttattaggtttgggttttttagtagatatatggtttaaaggttggttggttaaattatatgattttgtaattatttaagagaaatgaaaatatgtttatataaaaatttgtagattagtatttattgtagaattttttataatagaattatgttaaaaagtagaaataatttaaatgtttattagtagatgaagagatatatagtgtggtttatttacgatggaatattattcggttatgaaaaagaatgaagtattagtatttgttataatgtggatgagttttgaaaatattttattaagtgaaaggagttagatattaaggttatatattgtacgattttatttatataaattatttagaataggtgaatttatagagacgaaggtagatgagcggtggttaggggttgagagttcggagttgggaatggggattggttaatgggggtagggttttttttggggatgatgaaatgtgttgggattaatggcgatggttgtgtaattgtgatggttaattttttgtgttagtcgggcgtagtggtttatgtttgtaattttagtattttgggaggttgaggcgggtggattacgaggttaggagattgagattacggtgaaattttatttttattaaaaatataaaaaaaaaaattagtcgggtgtggtggtgggtatttgtagttttagttattcgggaggttgaggtaggagaatggcgtgaatttgggaggcgaagtttgtagtgagttaagatcgcgttattgtattttagtttgggcgatagagcgagatttcgttttaaaaaaaaaaaaaaaaatttttgtgttaattggattgggttatggggtatttaggtaatcggttaaatattattttgagtgtgtttgtgaaggtgtttttggatgagtttaatatttaatttttttattttttagaaagtttagtttattgttagtatttatttaattttatataaatacgttttttgaggttgaagtaaatttgattggatgttttgtgtgaaaattaaatataaaaattggttaggcgtggtggtttacgtttgtaattttagcgttttgggaagtcgatatgggttaattatttgaggttaggggttcgagattagtttggttaatttggtgaaatatcgtttttattaaaaatataaaaaattagttacgtgtggtggtaggtattttgtaattttagttaaatttaggaggttaagattggagaattatttgaatttaggaggtagaggttgtagtaagtcgagatcgtgttattgtattttagtttgggtaatagagagagttcgttttaaaaaataaaaaaattaaaaagaaaaaaaattttttaaattgtttttgtagttatttttaagtaaaataatagagttatttgagtcgtttattttggaaaaattagatttattaaatgaatttttagttaataattgattaagaataatgttaatattatttgtaggaatgttgtgttttttaggatttgatatttttagcgatcgagaattattatttttttttaaattttatttatttatttattttttgagatggaattttgttttgtcgtttaggttggaatgtaatggcgcgatttcggtttattgtaatttttgtttttcgggtttaagtaatttttcggtttcggttttttaagtagttgggattataggtgtttattattacgtttggttaatttttgtatttttagtagagatgggattttattatgttggttaggttggtttttaatttttggttttaggtgattagtttgttttagtttttttaagtgttaggattataggtatgagttattatatttagttgagaattattatttttttttaaaggaaatattattattaaaaatggaatgttataaatagaatgatgttttttgtttttaaagtcgatatattagagtgatgtgaaaataataataaaagtaagatatttttcggtaaatttattttggggtgaacgttgtagttataagtattgttggtgagtattttcggggtaaataggaaaagggtgtaattaggagtttgggtaaagtagattgtgtgttttgatgggggtgggttttattcgattagttgaaggtaatagggtttggaacgtatattttaagatatagtgttttggtatagtaaatatttttagttgaaggaatttaagaaatggtaggtttaagaagaatttattgatttgttttttttttgaagtagattataagttttttacgtaagaggtgttttttttatatttagcggaaaggaatagttttatttttagagatagaggatttgagaggggttttagtatataggttttgtcgagatttttacgggtttattgtttagtttattttttgttgttttgttatagttttttacgattttttattttttattaaatttagtataaaaacgtttaggtttaggttaggtatagtagtttatatttataattttagtattttggaaggttaaggtggttagattatttgaggttaggagttgaagaatagtttggttaatatggtaaaattttatttttattaaaaatataaaaattagtcgggtgtggtggtatacgtttgtagtcgtagttatttgggaggttgaggtatgagaatggtttgaatttaggagatagaggttgtagtgagtagagattatgttattgtattttagtttgggtaaaagataagtaaaagaaataaataaaaaaattgtttaaaataagtaataaataaatttaaaaaataagtaaaataaataaaaattgtttaggtttaggtcgggtatagtggtttatatttgtaattttagtattttgggaggttaaggtaggaggattgttcgagtttaggagtttgagattagttcgggtaatatagtgggattttgtttttataaaaaataaaaaattagttaggcggggtggtatatgtttgtagttttagttatttgggagtttgagttgggatttaagagtgggtttagagtagttttcggggtcggtagttgggttttagtttgagtttaggaagttaaggttgtagtgagtcgtgatcgggttattgttttttagtttggacgtgcgatagagtgagattttgttttaaaataaaataaaaatcgtttaggttaacggtttttttgggtttttatttttttatgaaggttcggtgttaagtaaaatttatttgaattgttatgtttgttttttgttaatttttgttagtttaatttttagggttttagttaatgaatttaaaatcgatagaaggaaagggtttttttttagattttgttttgattaggtttttgtaattttgtgataaaggtttgaaggtttgaataggaggatataaggtttgagtgagagagaatttttttcgtttaatcgtttttaatttggaatattagattttttttgttttagatttaaattgatatatgcgttttttttgggtttcgggattggaacgacgttattggtttttttgggttttgggtttttaggtggatattagagtcgtaatatgggttttttcgtgtttttagtttgttgatttattttgttaattttggtatttgttaatttttgtaatgaggtgagttaattttttataataataaatttttttatttaaatatacgtatatattttttattggttttgtttttttggatgattttaatataattattttgtgaatatagtaaaattattgaattgtagattttaaaaaggttaacgttatagtatgtgaattttatttttataaagttattatttaaatagtaataagaagttggtgagttttgtgtatttttttgtaaataagagtagggatagcgtcgtttttgttttcggatgtttttagtttttagttcgagtttaggaatattttttatgtgtttttttttttaattttgtagtttaagggtgggggcggtttttagtttggtattttttttgtagttttttattttttttttatattagttaatggatatagaggtttttttatggatttttatttttatttatttatttttatttttttgagatagagttttattttgtcgtttaggttggagtgtagtggtgtgatttcggtttattgtaattttcgttttttggatttgagtgatttttttgttttagtttttcgagtaattgggattataggtacgtgttattatatttagttaattttttgtatttttattagaggtagggtttttttatgttggttaggttggtttcgaatttttgattttaggtgatttattcgttttagttttttaaagtgttgggattagaggtgtgagttattaagtttagtttttttatagatttttaaaagggttttgggtaatatagattgggatttgttaagttattaaatgatttttttaaataaagaaggaagttataaatttttatttaaaaggagtgggggatggtaatagaaatatagttagttagaagtcggaagggttttatttaatttatttttaaggtttttgggtagaagggataagggaaaatttgttttttaaatattttattcggtattttatttttcggatgtaagatgtagttgtgtatagcggtagtagtgaggattttggtttggtaggtttttatattttttgttgagggttttaggggttagggttgtttaataggattaagaggaaatgattataggagtttttagttgttgggggtggttttcgcggttttttgggttatttttggtgaatttattttaaatttggaagaggtttaagttttttcgtttttcgtattttaaattttagttacgttagttaggagttttgggggatgagaaaaaatttaattaagttttattgtgttgggtgatataggatttagaaggagaggggtttttggattgtttaagtttaatgataattttagtagttgggtttttaagttaattagtttttttttttttagtagttttcggggagtattacggtgagttgtgaggagttagtttagtacggtatatataacgtaggggttttttcgtatttttattttataaatattagggtttttcgggggattagttttttatttttgagttattttttttttatcgtttttttaataaggaatagagaaggagtttttattgtttaattagatgtagaaattgacgtacgtatagagaggttacgtgtgatatggtttggacgttgttttttttaaattttatgttgaaatgtgatttttgatgttggaggtaaggtttggggggggtggggtttgggttatgggggtggattttttatggatggtttggtgttttttttacggttataaagttcgggagatttgattgttatagagtttgggagggttgggtgaggtggtttatatttgtaattttagtattttgggaggttaaggtgggtggattataaggttaggagtttgggattagttcgattaatatggtgaaattttatttttagtaaaaatataaaaaaattagtcgggcgcggtggtatgcgtttgtaattttagttatttaggaggttgaggttgtagtgagtcgaggattgtgttattgtattttagtttggttgatatagcgagattttattttaaaaaaaaaaagagtttgggagttttttttttcgttatgtgacgtgttagttttttttttattttttattatgaggaaaagttttttggggtttttttagaagttaagtagatgttggtattatttgtatagtttgtagaatcgtgagttaaataattttttagtttcggttattttttatagtaatttaaaatggacgaatataatgtattagtttttttttttggattttatagtgtgtttggttggggttgtgttttggggaaatggtaattgcgaggtttttatagatcgggttcgggttttaattatagtcgtattttagcgttttgatattgttgagtggatgtttaaaaagtattgttgggtgaatgtgcgagtgaatgatgaagatggaggtggttgttggtgttagggtaaggttttaggagtttggggaggtggtattaggtagtttaggttaacggttaattttggatagggttaggaggtagttagaatggttaaggatagttaagggattttaggtaagtggttttattttttttaggcgggtaggaagtaggaattagattaaggggtgttaggtggtagtggtatttagggggtttgaggagtaggtgtaggtttagtagggttggtggtgttacgtgtggggtcgatcgtggtttcgtttattgtttttattttttggacgtatgggtttatggtttttaaggtttttttttgtttttacgtttatttttttaggttttatttttagacgttaagttatttttttatttttatttttttcgttgtttttatatttgagttgattttttttttgagttttggtgaaattttagagagtttagaggtgtagtttatatttttgcgttataaggtttttgtagtttttatttttttgggatattttattttagagttgggtgtgtatttattttattggattagaaattttaggaatgtttattttgtatgtttttgttttttatttttcgttcgttatttagttcgtggttgttatgtggttgggttttggtagttatcgtagttggtaatatataattagtatttttgtgtttaggtttcgtgttgagtttttttagttttattttcgtttgtttttaaaatggtttttgatatggtaattattattatttattttttagataaaagattatagttttaggagaggaggaatggtaggtttgaggttacgtggttcgtaataggtaaatggattcggtagttattttattttcgagtggggtttttttttgtttgtagatttcgttgaggttttagagtttggagttagtgagtttttattgagtataaggatagcggcggtgtcggggttggaataaggtagggaggggttttttaaattatagttttggttgtggatttattttgggatttcgttttggttgggaattttgttttagtttattcgggatatttttttattttgagttttgtattgggttgtgtacggggtttgttgaatgagtgagggtaggagggatggtgagtagggtggaaagcgattatggtgggtaggtttttgttggaagtttgaaatatttttggcgagtaggaaaatattaggggaagaggttatagtttttagaagggttcgttggggattgttttgtagtttttttatcgggataggtagaaaatttagtttttttttagggtgagtttaggaagtttgtgggggtataggttttagttagggtggcgcgtgggtttatttaggggacgttgtcgtggtttagagttaggttaaattttatgtattttgtaaataattatttataataaataaggtttatttattttttaagaagagtaaaatattataggaggtatttttttattaattaaatacgttatagtgattttattgcgttattgagggagggtattagggtgttcggtttagagtaaattgtggttagggggacgggtatattgttaaatcggttagatttttatttttgaaaatgtgggttaaattttttttaataagttataaggaaatttagtgtgaattttatgtttttattattatcggttgttttggaagattgggaggaggggttttgttttttttttatttttggttatagggtttgaggttataatttggattgggattttaattttttttttggggaagaggtttatttagggtgtttgttaaggtttagcgtataaatacggaattcgtttaacgtttgtttcggtatttttgggttttttatattgggtttttttatttgattttttaagtagtgagagtgatgggatatggggcgtttttaggggagatttggggagatggagtaagttttttagtttaaggtgaggtttcgaggtatggtttatgtagtgatgttttttacgggaggtttgaggtatgattaggagtttggagatttagtagaggtttgggtatgggattttcggtacgtagttagagcgagggtcgaggttgtatggatgtaagtaggtgattttgtgttatcgggtgttatttgtgtcgggttttgtgtagtcgtttttattttattgagttttagggaggtgaggtaattattttaggtatatagtttcgggggtaaaggttggatttaggtgtgtttgattttagaatttaagaagataagtagaggagtttgagttttttgagatcgtagtgatggtttagtgttttaggatggttaggttggtttttgtagttttagttaatcgtgtttttttttagttatttagggttttagcgttggtttttgagatttggtattggttataggggtttatttttggttgtggatatttagtgttggttattgggatttggtattggtcgtggggatttgtttttggttgtggggatttagcgttggtttttgagatttggtattggttatggggattcgtttttggttgtgggtattcggtgttggtttttgagatttggtattggttatgggggttcgtttttggttgtgggtattcggtgttggtttttgagatttggtattggttatggaggtttgtttttggttgtgggtattcggtgttggtttttgagatttggtattggtcgtgggggtttatttttggttgtagggatttagtattgtttatggggtttgtttttggtttcggggagttagtagtgtttgtggggtttatatttggtggtggggatttggtgttggaggattttgatagtaaaattatagaggcgataggtaatagtaatttattagtatagcgtgtggtttgttttagttacggtatttttttttattttgtgtttttttattataaagtttagtgtaggtaacgaagttaagaggtggagaattcgtaggaggacgtatattatatttgtttttcgtgtggcgtttttgtattttgggtggttgagattttttgttttttttttaggttttttcgtgttaggtttgcgttgttttttttggtttcggtttttatttattcggttttttagttatagatagtagcgatttttttttttatttaatggggttattgtttagtttattattagtttttagggttggtagatgatatcggttacgggtagtgtttttttcggttttagtatataaggtataaaagatattattttgttttaagatttttttagttacgtggcgtatgggaagcggtgtcgggaattttttagggtagttttttgtttcgggggagatcgtgtttaaattttcgaggaaatgttgttttttggttttttttttgaaaaattttttaaggagattttgtgcggagcgtgtagggagaatggagatttttgtgagattgtttcgggatagttttatagaaattataaattatttggataaaagttgaaaatttgcggttatataatgttgattatttatttaaatattcgttgagtaagtatttatgacgtttgggaatttaggacgtggatcgataagatataatttttatgttcgttttagtgatagagagagagacggtattattaatttcgttcgttgggggtttttttggagggggcgtgtaggtttagggttgaatttgtttagtggatgtgttatttacgtttgcgtattttttggttttgtggtggtttttggaataaaggttgagagataaaagataaggatttgggggagggaggacgtttatgtatattttattggggatattagtaaggatgattgtttagtgattatttagtgatcgagttatttggtgtttggagtttggtatttatagagtagggcgggggtagtaggttttgtcgggggtataggtttgagaagggagtgttgttagttaggttcgacgggatagagagcgaagggttttttttttgaaggttatgtagaggtcggaggttaatgttagtaattttattaacgttagttttttgagatcgatttagagttggggttttaagagtagttttgggcgtttaggagttaagattttatagagggtgttttttatttttagtttagggaaagtgataaatttggagtgtttttgtttatggtttaattattgaatttaaatgaatgtattgataaatcgtatttagtgttatttatagggaaaagggagggaaaaaaaaaaaagaaagagagttaatcgcgtttaggtcggtcggttagggggaggatagatgggttattatttttgttattttttaggttttttgtattgattttttatttttagtaaaattaaggtttagttttttttcgtagtttcggagtcggttgggatgaagtaatttttgtaggtagattattaggtttattgtgatggttttagtagggaatttagtttaggttatagtagtttaggcgtttgtagaaggtttagatttttgggtgttaagttttttttttttgtattcgtttcggggttcggtggggtgggtagtgtgcgatttttagggttgatgaaagagaggaggaagaggttgagcggcggcgagtttgaatagttaattttgggaggggttgaggtggggaaggtttttattgttgttttataggtttcggagtaaggtttttatgattttattagtagttgggtaggtataggtttaggtgttgagtgtgttaggattttcgttgttttttgggtgggggcgagagggatttttatgggtttgtaattagattcgcgtttttttagttaattttttattaaataaatttatacgtatagcggattgggtatggtcgttattttcgggagtttttttgggaaagttttttaaggttttgttgagtttcgggaataggtttttatttgttcgggaatcgggttggtatttaataaataaattaaagttcggcgtcggaaggtagaattttgggattagagttttagttaagggttataagttttttaggaagttttttttttaaagagtggttgtgggacgttgggagtttttagggtggttagtttttaggtttttttaaagtttaggtggtatcgatgttttgtgttaaggtgagggttgtagagaggggtcggcggggaggagtttttatagtttattttggttattgattttatttttaagtattgaaataaagttttttttttatattttcggttagggagagagggcggaagttttaaatattcggggtgtatgggaaaggtttatatgtatagaagaattagataacggaagttgttggtggtggtgataggttttttaaaggggttttgagatttttgatatcggtagggaagttatatattgtattaggtttgggggtagggagaaggggtttttaaggacggggttgtttttttttgtggaagtgtttcgtattgtttgataagagtagtttggattagtcgtggtataataggaagttgggagaatacggtggtttaggaggttggttagggttggggagtggttaatttagagattttggttgtttaagtgggtttagggttttcggggtgaaagtttttgtggagtatagtggatttagtgttcggaggatagattttaggtttagataaggttttttttttttttttttgagatagagttttatttttgttgtttagattggagtgtagtagtataattttagtttattgtaatttttattttttaggtttaagtgatttttttgttttagtttttcgagtagttgttattataggtacgcgttattatgttcggattagttagtatttttagtagagatagggttttattatgttggttaggttggtttcgaatttttgattttaggtgatttgtttgttttggttttttgaagtgttgggattataggtatgagttattgcgttcggttaataaggttatttttgatatggaatgttggtttgattatagtgtttgatggtttttgtttgtaattatgttttcgttttttattaaagtagggtttttagggtagaagtcgtatttttttattttagagtgttttacgttattttttaggcgtatatagtgggttttttttatcgtagttgaattggttttattattattataatgatagtttataggggcgggggttagtgggaatataaagtggttaatgtaatagtgttttagttatttcgatatagaaatggttaggggatagaaggggtaagttgggagttagtagtaatttaggtttttagagacgagtattaaaaaaggcgagttatattataggttttttttgattatattttagtttaaaagagatttaaggagaaataagaattttatttttttaataaggattcgtatattagatgttaagtaaatattttttttttttttttgaaaaggagtttttggggttgtcgggggagttggttaaagagaatgatatttatggaaatatacgtggttttattaagttttaaggtaaggtggtaatgaatggaggaggaaaatttatagtattattagggaatggggtttttttttgttttttttttttttaacgggtttttttatgtgggatttaaattaaattttaattttattttgatttagtaggtgttgtttttatagtttcgaatagatttgttagaaaattattgtttaatttgttttcgggtggtatatttttttttaggaaaggaattataaatttattttagatgagtagagagttgttttttaaatttttgattaaaatatagtagattttatatgaaaaagtaaagagagaggggttagggatgaagtgtagtaggttggaggttgagttagtttttagagttattgggacggcgttttaggagtagatggtattgtttataaagtttttcgtttttttttgttttgaggtcggggattatttcgttggttgtatgatttagtttttggggtttttttagtatgaaaagattttttgaaagtaggttcgttagggagattttttagtttttgtttattgatatgtttttgtatggtcgatacgtagtatgttattgtagagaagtaaagtatacgtagattagtttcgttagtagtatttttttttttcgttttttttaggaacgttttgtatatatttaatatatttaggaatttagagttgcgttgtagtagtagttttttggattttagtgtcggcgtcgcggggagtttcggttacggtatttcgagtattgagattatttttagtttttagttagtcggttttcgggagtttagaggggtgataatttgagcggagtgattttagagaaagcggtggttaattcgaatttttttttggtttttttggaagttagggaaattttttgcgaaaaggaaatatgttttaagaagtttcgggtagtaggagaatttagttatttagtttagttggttaaatatttataaagagatagttgtgattatataaagttttatttttttattttgaggtcgaaaatttggttttcgcgtggagatcgagtttttcgttattttttttttggggatttcgttcggttttgtcggtttcgggtcggggtttagggatagcgtggttttcggtatcgttattatggttattagggttcgtttcgcggtcgcgttatttgagagttttcgagttagtggtgtaaggttgggaagaataaaggagtaggatttattttagtagcggaacgtcgggttgcgttggacgcgtcgagagtcgcggttcgtttatcgggttatatggtttagagtcgagtagaggattaaaggggttttgtggtcgcggaataaggagttttttagagcgcggggtagaggtagggagggatttcgattgtttgggaagggaggttcggtggggaattgttttaagggggtagggcgaggggagtaggaggagggggtaggtagagataggggcgtttagcggtaggttcggcgtagaagtaatttgaaggtacgggagggacgttaaggagttgttatacgttaaaggaaagtgatagggtttttgggaagagtgagggggagttgttaggaagaagagaggggaagaggtttttagggatttttggttatgtcgtttttgtttttgtttttgtgtttgttagaggcggtgttcgtgaggagttttttttttttagttaggttttgaaattgatttggatattttttttttttgtgttttgtttgatatttttgttttttaggtgtttttttatttatttgtttagatatcgttatagttgggtttttagggagtatggttagttattttagaaagttatttagatttgtagttagggttggaatatagttatttgggtttgttttttttattttaggtgtttgttggttgggattatggaagggagaaggagtaggagaggaggggtaggggatgggggcgtagtttattttgagtttttttttcgagagtttttggatttagatttgatttagtttttgtttttttagtttttttagtttttgggggatttggttagtgagttagtttttttttttttttttttttgtaggtttgggatgtgttgggatttagaggggtataagtaagggggtttttagaggagggagttgatattataggggttgggtttggacgttgggatttgttagatttattttagtgttacgatttttgaatttaagtgagttatttttagtaggggcgtggttatttttatattaggagagagcgtttgggagtgggttcgtttcgagggtttgttgggggttgggagggatttatttaaatggaaagaagtttttggtgatattttttgagggttaggggttgaattttggaagttacgtttttaggtagtttttacgggattttatgttgagtgttgattgggttttatatatttttattttttttatttcgtatttttatacgtggttgggggtgattgaagtttcggggtattcgttatattggttaaataggttagttacgtttagcggttttttagttagtagttattggtatttgattcgtcgttttttattttttatggttaattttttttttaaggttttttggttttacggttttttttatttttatagtgaacggtcgtggggagttgttgttattggttttcgggcgttaggttagagtcgggggagtgtttgggagaagattgtatgttcggagtttttgtttttatttgaatgggagggaggttggtggtagattagagatttgggttttgagttaaatattgaaatttaaggttttgggtttgttatttaatatttgtggaatttgattttttttatttataaaatgggtattattaatattagtcgttaaaattatagtaagatatatacgtttaggttaggaagtgcggttatttagaaaatatagttttttttttttttaagaagttaatttttttagtattgggagtgagaagagtttgttttttttattgtttgtagtttagtttagggtatttttattattggtttttaaagggtagttttagaaatcgttgataaaggatgttagaaggaatttttttttggttaggtgttagggttaatagaaagtttcgaggatgtagtttttattacgtttttgtttcgtgggttttttttttttcgtgggtagaattttttttttttggttttttttttcgaatttttttttttttgtttttggttttaatttgttttttagttttttggttttttaggttttttttagggtttaagattttgtttttttttaagtttagttttttttttttttttgtttttggatttttgagttgggaggttagtattttgggtgttttgttgaggtggtcgttttttttgtagtggttttttttgttgttattaaatgagggtttttagagtatagagaaggtattttcggtttggggttgtattttttatataaagtttttgttttttagtattttttaaagttttttatcgtttagtatatatttagtatttaggtagagtagttttagagttttttcggttggttttcggtttaattttttagtagaaacggtatatgggttatagacgtaattttatattttttagtatttataataaaaaatgtaagaataagttaggtatagtggtttacgtttgttatattagtattttgggaggttgaggtgggtagattatttgaggttaggagtttaaaattagtttggttaatatggtaaaattttgtttttattaaaaatataaaaattagttaggtatggtagtagttatttgtaattttagttatttgggaggttgaggtaggagaatcgtttaaatttgggaggtaaaggttgtagtgagtcgagatcgtgttattgtattttagtttgggtaatagtgtgagattttatatttaaaaaaaaaaagaaaagaaaagaaaaaggaaattattaaaaaatgtaagaataggtgatattaattttaatattatttatttaatagagtttaaaatattattaatttaatatgtaattaatgtaaaaatgatagatatttgatattttttttttttttttttgttaggattttgaaatttagagtgtattttatatatacggtatttttttatttggaattattatattttaggtgtttaaatggtttcgtgtagttagtggttattatgttggatagtgtagttcggagagttttaatttttttttttttttttggttgtcggggaatagagttttgttttgttatttaggttggagcgtaatggcgtgattttggtttattgtaattttcgttttttgagtttaagtaattttttcgttttagttttttaagtagttgggattataggcgtatattattatgttcggcggttattttttgtatttttagtagagatggggttttattatgttggttaggttggttttaaattatagattttaattgattcgttcgttttagttttttgaagtgttgagattatacgcgtgagttattacgtttattttcggatagttttaatttgattttaggataatattaggttattagagagttgttgatttggattatattatgatttgaattttttagattattttcggtattatgtttataagttatatttagaggataataggatatagtttggtgaaatatatagcggtattttttataagatattggtgaggttatagattttattattagtgttattcgtttggggatattttatttttagaaaatgtagagttttttttaagaaatgaatgtggttaggtgtgttggtttatatttgttattttagtattttgggaggttaaggcgagtatattgtttgaggttaggagtttaagattagtttgattaatatggtgaaatttagttattattaaaaatataaaaattcgttaggcgtggtagtgtgtgtttgtagttttagttatttaggaggttgaggtaggagaatcgtttgaattcgggaggaggaggttgcggtgagttgagattacgttattgtattttagtttgggcgatagagcgagatttcgttttaaaaaataaataaaaaaagaaatgaatgttttaggtatacgttaagtattttttagacgattttaaagatattaattattgtgattgacgacgatttttttttttttttgggtgtgtttgttttgtttttttagtttataggtgtttaggatttaaaggtagttcgttataggttatgggatttggttggtttaaaagggagagtgaggttattggaatttttttaggagtgagtttgaagtttggaatgttttttggtggagggttttgaagttaggaggcgatgtagacgtgggggttgagatattatttggggttatttgtaaagagggatatttaggtagtgattttaaggaaagagtaaggggaggagagggcggtatatttacgtttttttaatttttgttcgttcggaggtttacgtattttatacgtcggttttttcgtatggatatttttttaataagtaatttatcgtgtttatgtttatttattttaaagttatatagaattgtatttattaaaaatgaatttatggagatagaaagtattttggtggttgttaagggttggagagggcgaatggggagtgagttttttatggatacggggtttttttttggggtgatgaaaaagttttggcgttagatagtgttgatggttgtacgatattgtgaatgtatttagtgttattaatggtaaattttatgttttgtgtattttagtataataaaaaaatatatatttaaagtaatagaatttaacgtgtttttttttttttttgagttagtttgtttttttgttttatattttaaaattagaagggttttgagatatattataggtttttagggtaggttgaataattttttttttttaaattgtgttattttatgtggtaatagggattttgtagatgtaattgaagatgttgagatgaagagattatttaggtgggttttaaattataagcgttttttaagagggaggtaggttaggtgtgatggtttatggttgtaattttagtattttgggaggttgaggtaggtagattatttgaggttaggagtttaagattagtttggttaatatggtaaaattttgtttttattaaaaatataaaaattagttaggtgtagtagtatatgtttgtaattttagttattcgggaagttgaggtaggagaatcgtttgaatttaggaggcggaggttgtagtgagttaagattgtgttattgtattttagtttgggtgatttcgttttaaaaaaaaaaaagaggaaggtagagggagatttgattgtagagaaggaggaggttgtaggaggatggaggtagaggttggagggatgtagtcgtaagttaaggaattttagtagagttttttatttaaagttggaagaggtaggaatggattttgttaatattttgattttagttcggtgagattgatcggtttttgatttttagtattgtaaaggaaggagtttttgttgttttaagttattgagtttgtgataagtagttatagcggtaataggaagcgaatgtagtttttagtttattttttcgtttatagtaatataggcgtttttttgtgtagaattttgttaggtagttagtgagcgggataggattttttttcgtttttattcggggttttgtgttggattttttaaggttgttgtttttgagatagtgaattttttatatttatagagatttattttaaagttgagaaagtgttttttttaaggggcgttagaaagaaggttttaaggtgtttttgttatatgtttatttgtttgtgggtaatatttatagttttttttcgtgatttatttaatagaagggttataggggagggagtattattggttagtttattttatagtaaggttttattttggaagttataggggatagttgggatttttatttttaatttagttaattgggagaagagtttagaatagttttggaggttgatatttgttaggaagtgtggtgatatttacgtgttgttgaaatatatagtaatatagtagtagagaggaggggatgtggttttatagttttttttttatttatttagtacgtacgtatatatatatatacgtgcgtgtatatatgtattaatttttagtttttaggttttgtattttgtttttgttaagtttttcggttattattaagttaggttgtgagtatagagtttagtttttttgttaatttttttttaatttattttgggtaatattttaatgggatgtagtagatgttttttattaaatgttaagagtaatatttttttttattttttgtgagttggcggtcgcgtttttgtatgggggtgcggaggaaagggttggggagtaggaatgtggttttgagggttggtatgtatttgtagttgtgacgtttcgaggtagtttatatttttatttatagattaattttgagaaggggttgggagtatttatagtttttgttatttttgggttggtaggttggggaaattttgagtagttcgagtgaaggtcgtttttaggtaggtatggtgggatagaggggtttttgtatattttttgtgaggtagcgtagttgttgggttgttttagtatatttgggtgatatgttttttttttggtttttttttatttggtttgggagaacgtttaggatgttttaattttaaaaataagtaaattttttttttttgatttatttatttttttaaattgtgaattttttttttgtttgaatagtttaattttttaaagtaggtttatattacggtttttagttttttatcgtttatttattttttagttcgagttatttggtgttcgttcgttttattattaatttagtttttgaaaaaatttttatggttagtatttagttttattttatttgatttcgagggtagtgtttgatacgtattagttggttttttttttttttttttttttttcgtattttttagtgttggggtttagatagtttttaagggttttttcgttttttgatttagttttttggagtgattatattttcgttttagttttttagtttagttgtttttttatattttgttttaggttttttttttggaatattgtttgtttttagagatttaagtttttattttttatattttttttttcgatttttagtttttttattaaagttttattggttgttttttttcggtgttttaaattagtttttttttgtttagattttataaggttagtttttattttatgattgtttttttggattattgggattattttttattaatatttattttttatttcgtttttttttgtttatgtagggttttgttggaggatttttttcgttttattatttttttttttaaatagttttttaggtttttttgttaaagttgaaattttttttttgtattcgaggatttttgtaatttggttaatttatttttaagtttgaatttttatttttgtttaaggagtttacgttttttagttaggttttattgtttcgtaaattttatttaaaattttttttggtaaatgttattatttttaggaagtttttttgatattttttattatatgtgatttttatttttagagttagattttgatttggagattttgatttttatttatttttgttttttttgagttttttaggttgtaggttttagtttatgtttgtgggtttttgtagtaggagggtttatttttatttttttaagaagtgttcgttttatttttcgttaagttgtaattttttataagtaggtatttttaatatgtttttttatttttttttttttttttttttttttttgagacggagtttggttttgttgtttaggttggagtgtagtggcgcgattttagtttattgtaatttttattttttaggttttaagtgatttttttgttatagtttttttcgtagttgggattataagtatgcgtcgttacgttaagttaatttttttttgtatttttagtagagatagggttttattatgttggttaggttggttttaaatttttggtttgaagtgattcgtcgattttagttttttaaagtgttgggattataggcgtgagttattgtatttagtttaatatgtttttttatattttttttgaaaagttattattatattaatagtgtgttttataaattgataataatttaaaatgtgatttattattaaaagtgtgattttatttttaaataatattgttggttgtggtttgtagttagttttattattttcgtgtgatgattattttgtagattagtaatggttttaggtttatatttaatttaattattttgtttttttaattttatttttttttgagttaatattaagtgtgttttagagttgtaaatttatggttgatataaaattaggatttttaatatttaatataaagtaatcgggttttgtattggttttaatagtaattataaattacgtttgttttttgtattgggtatattgtatttagtttataatatgtgtttttgttttttttattttttttattaagatggtatataggtttaaatttgttttttgggagtaattgatttttttttggaagatgtgagtagtttttatattatatttaagaagatattgttataagattttatattttttattttagtttttaagggtttatttatttttttaaaaatttatttgttttgttataatatgtgtttttttttttttatttgtttttttaagatatagttttattttgttgtttagattggaatgtaatggtatgattttagtttattgtaattttcgtttcgtgggtttaagtaatttttttgttttagttttttaagtagttgggattataggtgtgtattattatattcggttaatttttgtatttttagtagagacggggttttattatgttggttaggttggttttgaattttcgattttaggtgatttatttgtttcggtttttcgaagtgtcgggattataggcgtgagttatcgtattcggtttataatatgtgtttttatttttttttttttttttattaagatagtatacgggttttaagtttttttttttttttttttttttttaagattagttggttgggtgtagtggtttatgtttgtaattttattattttgggaggtcgaggtaggtagattacgaggttaggagtttgagattagtttggttaatatagtgaaattttgtttttattaaaaatataaaaaattagttaggcgtggtggtgggtgtttgtaattttagttattcgggaggttgaggtaggggaatcgtttgaattcgggaggcggaggttagagtgagtcgagatcgtgttattgtattttagtttaggtaatagtgtaagattttgatttaaaaaaaataaaataagtgggaagaggggagatagtggaataaggagtttaatttgtaattgattgtgaataattaattgagataatttattattttcggattagttacgggttttattttttatttgtttttttgagttacgttttttagtgaaattttatacgtatgtgattaaatttgtttttttttttattaatttattttgagtgagtttaatttatagatttttaaatattgaatttaagagggtagaggaaatgtatttttttttcgttataaaaatattttatttttttattgtagtgtcgtttgttttatttatagtcggtaatttggatttcgttttttaaagtttatgaaagtaggatagattgtttgtaggatgttttcgttataaaaggagggttaggtttggtaggaggaaagaaacggaagtggtaaacgtttattttttgcgttagatagaggtattaggtgtttattgttttggggagtaaatatttttaaaaacggaaagaaaaatttttagttttattggggtgtaaaaagttatgatttttttcgtggttaaatggttgggtggtttgggagataagcggtagttattttgaagtttagtttatttgtttgtaaatggagggtaatgaaattatttgttgtatgggtgtttgataggttgttgtttaaattttttgtttttttttatggggttttggggaagattatatgagttagtaatataaaagtattttgaaaattatacgaagtgtttaagtatgggggcgttggttgattttaggtttgtttttataagttggtagaaaattttttagagagggttttgttttttttttcggggtaggggtcgtagtgttagatttgatggtattggtggttgtttaggttatttggtatgagattgttgttagttttagatttattttaagtttgggagggaagtaggtcggggtgggggttttgaaattttttatatttttggtagagatattagggtaggtaaaagtgttatttatggtaaattaagaagtttgtttgaattgggtttaaattagtttagtttagaatggaggttagttttattttttttttttagaattaggagtttagtatattagaggttgagaaaacgttggaatagtttttttatttgtttgtttagagatagggattttaagttatttttttttttagtttattttataaattttttgtgttagattttttttgtttaggagttataggttttatttgggagttatttagggttttaaggtttttattatttagttgtttattttattaggttaggtttgtaggtatggagattagtaggatgtggtttaaatttggttgtacgttgattagttgagtgattttgggtttattttttaatttttgggaggtaatgtttttttatttgtaaaaaggggaaagggtttagcgaggagagtgataagtaaaggagatggtatttgtgtagacggtattgtgcgggcgtttagcggatgattacgcgttatttttttgttttttttttttgtttttgtgggagcgtgggtagtagggagttaagaggaagggagtagttgttcgtttgggacgtaggtcgttttgaattggaagagaaaaaggaataagtagtagttgtttattgataagttttatgtatttgtgttttaaaattttaaaggtgtatttgaaagattttttgggtaaatttttttttatagatatacgaaagttaggtgtagtggtttacgtttgtaattttaatattttgggaggcgaaggtaggcggattatttgaagtcgggagttcgagattagtttggttaatttggtgaaattttatttttattaaaaatataaaaattcgtcgggcgtggtggtgggcgtttataattttagttatttaggaggttgaggtaggagattcgtttgaattcgagaggtggaggttgtagtgagttaagattgtgttattgtattttagtttaggtgacggagcgagattttattttaaataaaaataaatttaaaaaaaaggtatatgaaaaaggtaaaatgttatgagtgttttgtcgtaatgtgttagttataaatgggaattggaggattttttaagttatttttttttttattttttttttttttgtatatgtattaatagttttttgggtgttggtagtattaggggatttggggtgttttataggttttgtttgtttagattttagagttaaggaggagatataaaagttaaaatagggtggtaagtggaataaatggggattagatggggtaatttggtagtattcggtaaggttttttttaatgagtttttaaagaggtttagtttttaggggaaggaggcgttttaggtagcgggggtttgtagaggcgaaggtttagggcggggtttttagggaagtcgtttaggatgttcgaaaggaggggagtaatttacgagtttggtgatagggtcggttataaagtgttatgaagtattaattaggttgtttattagtttttaggatagaaagattatagtagttaaggtgtggggatttgtttatttgatttttatttagtttagaaaatgattgttttagggttataggtaatagtttaagttttgtaagttgttggttatagggtgtagttgcggtaaggtggggacgtttattagttaagttttttaggatttttgggttgtcggatatgtttgtaggacgttacgggggtaggttagattaggggtatttttatttttttttttaggttttagtttttaggttagagtgttttttggtttttggggtttttagggttgtagatagatagggagaggtttgtgttatggtgggttatttggtttttgtaggaagtggttagaggttttagtatttggatatagtagttatttttttaatttttgttaatgttgttgttgttcggggtttattttttttaatttttttttttaattagggaggaaagtattttggagtaggaattgggttatttagtttgatattttagtatgattttgtatgattttgggttagttatttaatttttttgggtttttatttttttatttgtaaattaggtagataattttttaaagttttttttagttatagaattttaagtgttaaaataaaaaaaatttataaaaaggaaatatgtgtttagtttatattttcgtttttatttgttaaaaggggaaatggatttgttacggggttttttttttttaaatagatatgggagattttttttatgattgtagaattggagtagtttagaggagtttagaattttttagagtttgagatttataggggaatttattttaattttttcgggatagaagtattgttgtttaatggtatttaatttttattattgttgtagtaaatgattatatatttgtgatgttaaataatatagattagttttatattttattttattaggttatagggaaggtgtttatagggttgcgtattttttcgaggttgtaggggagattgcgtttttttgtattttttgtttatttgtattttttggtttgtggttttttttttttttttaagttttttttattgtattttttagatggtttattgcgtttttaaaaatttttgtgatgatagcgggttcgtgtggattatttaggattatttttttattttaagattagttgattagtgattttagttggttttgttatgttatttaacgtagttttaggtgttggggattaggatgtgtttaattttgggagttattattttgttaattttaagatataggttttggagggagatgaagggtaggattataggtttaggaggttgtttgcgtgggttcgaattttggttttattattaaggaattgggggagtatattatttgtaaaatgggggtcggcggggaattagttttttggttgttagcgtagagtgaggtagtgtgtgtagtgtttggagtagtttcgtgagtatttgtttttttttcgttaaatttataagaattgatttcggtttaacggtttttttaaatttttagtttttttcggttataaggttaggagtatttttttgtagggttatttaagtttttagtttttttgaaagtttcggtttatacgatgttggaagtagatgtgtcgtgggttgtttatttatgtatggttatcggagaggttcggatgatgtcgtttttaatgggtgtatagtgtagggtagggttaggtattaataattagttatagttattagcgtaagtaaggggtttttattgttatttttggtttggggttagggagaagtttcgggaggtatttgatttttttatagggagtggggttataggagaatgtattcgaaaggggttggggggtagtagaaagttttttttagaaattttatttttggttcgtgatagatgatttttttaggttattattggggtttatttgggtttttgtagtatggagtttggttattttagaaggatgattgggtaggttagggttattggcgatggtgacggtaggtttttttgaggtttttttattagaagtattaggaggttagagtagtcgataagtttttatttggtttttgaggggtagaaggttttgagtagttttttgatttttcgaggtttttttattttattgagagattttcgagagtattgagagttattttttggttttttcgtgagagagttggttatataaaggtagttatatatttagtaagatgaatttataatttttgagtttaggtttatttcggtttttttatagggagtttttgggggcgtggggtgggggtgtagaagggaggggtcggtgttttatttttgggaattaggttatgagttttggatttaggttaaattatagaggttttatttttttttaggttttttgttttttaattatttttgtatagggtatttttttttttttcgtagggttttattggggtggggtgaggaggagttatagaattatagtagttgttatacgggggtgttaaggtagggatgttgatgttaatcgaatgggtacgggaaggtagagtaggaggtcggcgttttgggtttggttaggttgtgtgattttagggaatttattttatttttttcggtttttagttttttttattgtaaatcgagggagtgaggttaggtgatttgtataatcgcgtgaatttgtgttttgtattttttatttattattttaaataatgtttttaaattttagttttttaatgtttcggtatttttttgtttgagaaatatttacggttgttttttatgttgtgttttaaatataggtattttggtttttttttgggtgtttttattagggttagaatgggtagtttattttgtaggaatttttaaggatttttagttatttttaggatgggggttggttgttcggaagcggtttttgtttattttcgtcgtagtttttattacgaggttagtgtagtaaaataggaggtgtaggtggtcggggttaggggttaggttattttttttagcggggtaggagaggggcgagaaaagttggatattgattattttaggttgagggtttgcgtggaggagggggtttatggtaaaggaagtgggaggatgggaaggagtttttgttggatatttttatttcgttggttttagtttcgttttcgttttatttgcggggagaaagtgaggttttttgttttgttaaattttagtaatgaattttatatttattttattttttgtttattggaaattttttttttattttttggattcgttttgaatagttgggttgtagaagtcggtggaatgaaatatgtagggtggtttagaggggattgtgtcgaatagcgttgtgttttcgtttatttttttttttgaagataaggtttttttgtttttgttttttttttgggaaagttggagagggggttgaggaaatgggatttattattaattttttcgtgtacgttggtttttagtaggtatttttatattttttaattaggttcgtagggtggaaaggtagtcgtcgagtttaatttaatttttatttagtcgtggaagttagtgtggatggtaaagtatttatgtataaatatatatacgaggttgaggttaagagaatacgcgtttagtttttttttggttttttagtaacgtttttatgttttagttttgttttaagttttaaacggtgtaaggtttttttaggtggaggaatggaagtttttaagaagttcgtgttttagggattatatagaggtagggtttaggagtaaaggtttttagatttcgtagtgcggcgttggtaagtttgcgttgttgtatttatattgttttgggatgaaggcgatatgttgattttttttaggtggttgtaggatagttaggaggaggtgagatgttagttaaaggtagttatagataatagtattacggattattagaaacgttattttcgtgttaaagcgttcgttttttttagttgttttattttgtgttaatattttttgggagtgatatgtgtgagattgggttgtgttgatgagtgattattggtatttttagattatattaaggaggggttattttgttgttaattaggtgtagggtaggcggtattggggtacgacgattcgttcggtatggttgttttatttttttttttgtttgagtataggttggtaggtttagaggagaggaggaaatagagttattatggggggcgtgtttaggggtgagttattttaagaagttatagaattagggtatgggagatattgtttagttttgttattaatttgtcgtgcgaagttggttaagttattgtatttttttgggttttaggttttgtaattagagggttggtcgaagaggtaaatgatagtggttagggatgggggtattgaagttagatttttcgtattcggattttttttttgttatgtttagagggaggtttgggtaggttatttaatatttttgggttgtgggttttttatcggtgaaatgggaataataatagaattaattttatagtgttgttgggaggattaaaggggatatttattttaggtaaagagtttttaagatagttcggggtttttaggaagtttttgttattattatcggatattattatttttgttacggttgttagggtttcgtttagtatcggtagtttgatgtcggtagaggaagggtgaggtttttgtttttttgtagcgttttttttttttttttttttttagttatggtaataatagttgaagtttatttttagttttagcgattggttatttttttgaattaaggattgaaggttttaggtttgttatttaaggtttaggtgtaagaggggtgagttatcggtttttgtttttattatatttaggtttttatacgtttttttaaataggtttttgttttacgtgtaagagaagatgttaatttttacgtttggggcgggggtgtttataaatgttttggacgtgagttttgacgggggttatggtgtaggttttgttagggtatttttaattataggggattatttgtagtttatagagggttttttgtaggttaatgggattttgttattttggttgttattttgtttagttatttggtaaggaaaataggttgtagatttagaggtagtacgggtttatatgttagcgagataatataataagggaaggatgtgtaggacgagggagttatggagattttatcgtagttttagttatttattagtagattttgtgcggacgtcgggtaggttattttattaatttttaggatgtttttgtaggttttgcgggtggatagggtgaacggaggtataaggagggtaagtttgataggggttggggttgggtttggagttagaattttagttagttttgttatcgtattttagggtatttttcgtagatagtaggttaaagtaaggttgtttagattaaaggggaaggggttttgttttttttattaagggttttttggagattttaatatagatttttagtttatagatattaaatttagggtttttgagaagtgagaaatgtgaaaaacgtatagaatagttgtagtttagcgtttttaatacgttagatttatataggtatatatagcgtttttgtagaggttagaaagttttgtgttgggaagtttttcgatcgggggaggttttatagtaagtttttttttttgtttatttattaacgggcggaaggttttaattaggattatatgggaagggttagcgggaggggtagagagggaaaatgaataggtaatattaagtgtttggggcggggggcgtaggggatatttaggaggggagggtaggggtgtattttttatttaatttatagggaacgggggttcgggaggtgtaggagaaggtttcggtatttttatttttttttttttgtagatttatttatagtttgtttacgggtagttagatttagttataggttagacgttcgttttagttttatttttttggtttattgaaagtaagttaggatagtgagggggacgatgttgttattttcggtatggttatgttgggtttcggggtgggtgggaacgtggttggggcgttattttttttggtcgttataggtataaaagttttttcgtgttttagtgttatatgtgggttttttttttgttgttttaataggacggatatttaagtagattttgttggtcggggggggttttcgtatttagttttattttgatttagcgaattttttttttgttttttggggtaggagttattaggtcgggttttaggtaatggttagtgaaggggttgtatggaggggttttttaggtttataggaagggaggttttttttttttgtaacgtggttgtagtattttgtgatcgagagggatattacggttggagatggtgggatggaggattttttatagtattttcgatgtttagaatattttattttgtataaaaaagttttaaatttttttgagggttgaagttatttagagttggggtttttgttttttaggttaaaagtattttgtcggagtagttgagagtatagcgggaggggaggggtaggagggaatagtttcgttacggcgataggggattttttgattttaagagggtttgtagatattattatttatttttagttttgaattgttttttgttaaggggttagaaatttttgggagggggattatagggggtttcgtttatgagaatagtgattgtggttaggttatagtttataagttagtaattttgtttagtcgtcgcggtggtttttttttgatggtttttagaaaaagcgttttattttttgttattagtgttttgaaatttaagaatattttttaaatagtaattgtagtaaaagttaatgttgcgtgagtgtcgtaggtattatttttagggttttatatatttttcgtttagtttttataaaaattttattttattttttttttcgttttttttttttaatagtttagaaaacgagtacggaagggttaagttggtttgaggaggggttggtggaatagtttgagggtttagtttttaagaattttatattgtaaagggaatttttgggttagggagtagggtatagtttttatttttttattttcgtttttagtattaggtttgatatagacggggtttcggttatgaataaatgaataagtgaatgagagtttgttgagggaagaaggtgatagggataagggagaaataaagtagttaatgtcgtcgtgatgatgacgatgttaacggtagtattgatatgtgggtttttgttatgttaggatcgttttaagtattttgttttatgaatatttttgttttttattatgtttcgagtggatatttttattagtttattttatagaggggaatatagttgagcgtattggttaaggttatgttgttaggaaaggttagagtttaggtagtatgtggttttttagtcgggttttggtttatacggttttataggtagttttatgaaatacgtagagagagtatgtgaggggtttttttgttgttttttatttttagttggggtttattttttgttgaaatttttttaatttgtttttaagtttcgttagttacgaaatatttttttgaatatttagtattatttttttatggttatttggttttatttttttatagggtaagttttgggcgaaaagtagaaaggatgaaaatttttgagagaggtgataacgtggtaatttttttttttttttttttttttttgagatagtattttattttcgttgtttaggttggaatgtagtggtacgattttggtttattgtaatttttatttttcgggtttaagttatttttttgttttagttttttgaggagttgggagtataggtatgtgttattatattaggttaatttttgtgtttttttgtagagatggagtttcgttatgttgtttaggttggttttaaattcgtgggtttaagtaatttgtttgttttagttttttgggattatagacgtgaattatcgtgtttggttgaggtggtttttatataaagtagagaaaattatttttagtttaaaataaattaataagtattgagtgtttatgtagaaaaagattagaaggaaacgtgaatatgttaatagtgtttgtttggaggacgtaattattattgattattttttttatattttttaatttaattattttgttataagtaggtgtgatttttaaaattataaaagataaacgttggttttttgtttgtgttttgttttttgagatagggttttattttgttatttaggagttggagtatagtggtgtggttatagtttattgtagttttaaatttttaatttaagtaatttttttatttgagttttttgaggagttgggattataggtaagcgttattatttttagtatttttgttgtttagattggtttcgaacgtttggttttaagcgatttttttatcgtagttttttaaagttgggattataggcgtgagttattacgtttagtaaagattgttttttaattaggaagatagatgttttttagtattttttgtttttttttttttttttttttttgatacggagtattgttttgttgtttaggttggagtgtagtagtatagtttcggtttattgtaatttttgtttttcgggtttaagagatttttttgttttagtttttagagtagttgggattataagcgtgtattattatatttggttaatttttgtatttttagtagagatggggtttcgttatgttgattagtttggttttgaatttttgattttaagggatttattcgttttggttttttaaagtgttgggattatatgcgtgagttattattttcggtttgttttttagtatttttaatttttgttttttggtattatttggttaagtagatgaaaagttttagtgagttgttagtcggtattaggttggggttttttttaggtagttttaagtggttaggatttggttttttttttagagttgggtttagaaattaagatcgggaatgcgtgatggttgttttgcgggtttttgttatgaggttatttttttggttttagtgatcggtcgttggttgtagggagtatgtgggtttagttagggtttgtgttaatatggttttgttttatttacggtttagtgggtttttttatttttcgttgtatgataattttaggaaaaatgttaggagggagggagtcgttgggggtgtgataggagagattttttagggatagatttgtaaaaattgttttaaagttttttttaaggatttttaaggtttttattgttttttattgataggttacggttcgggtagagaaagttggggatggagttggcggggggagggtggttagtattcgtaaggtaaggagatgagttgggagaataggggttgggagggtagttttaggttagtttttgtttttagaattattgttttttttttttggttataaagtgaggttggttagatataggtttattttataggttgggaggttgggcgtgaaagtattgtgtttgtatggggtattttatggtgaatattattagagttaatttttagggtttgttgttttatagggaagttagtgtaaggcgtttatggaatttagaagtatttaaaggatttgatagttatgagttgggaggatttagttttgtagtaggagaaagagaggtagagagataggtttcgtaatatttgttttattcgttgtgttgttttgagtatagtttatttttttgtggtttcgagttttagttttgaggtttttaagattttttgggttttcgtagtttaggatgtttatttgaaaattaggtttagttagtagggtttttttcgttagtttattattggttagtttttgtttagtattttttagtttattatttttatttgtgtaaattttatattagtattttaagtttttttttttttaggaaggagattgtttttagatgtgttttttgttttttttcgattaaagtttagaaaataggaattagttttgcgttttttttttttatcgaattgttggtttttttggatgttttttttgattttttgttaatatttttataatataattagtttttagtttttttttaaatgtaatcggcgagtacgttgtagtttaggcggacggtgatgtttttattttgtaatttgcgagagttagtatattttttagttaggtgggttgtaggagttagtcgtggcgagggtaggaggtttgcgtgttgacggtatcggtattattaaaattacggttagattaaggttacggttaacgagtttttttatttgtaattttttttttattaaggtggttttagttttagtttcggttttagttttggttttggttttaggagttgtagatatatttttaagtttttattttaggagtttggttttatatatatcggaggatacggagttggggtataaatagttaagaataggtatatttgtaattaggagtagggggcggagggttgttgagatgtttttatttttatcggttgttttttttgacggtttattatttattatatattgattgtataattagggttgtgatatgtttgttttttatattatattattaaatttttaaatttgtttttaatttatatacgatgaggtaaatttagagttaataatttgtttattagtttttgaatttatgggtggttttaatttttttttttttagtttttttgggtttatatgagtattgaggtataagggaattttattagttgggaagtgtgttttttttttgttgattttatagtttttttagtttgtgtttgaagttgttaatatttttttatttagtattgttttttgtagtttgagttgtcgttgtgtgatttagggttagtgttttaatttttttggattatatttgtaagatgaggatgtcgtcgtatagtttattttaaatggttattaagttgtttgtatagttaatatttgtcgagtttgtgatacgattagttttgttttaatttcgaatgtggtatttttatttagtttgggggtggaattgttagtttttttttttttggataaggaagttgaaaggttttagaaggtattaaggttagttgatttgttagtaggtatagtgtttatttgttatttatagtttttttttgatcgtttcgtttgtttttttagttgagattttgtgtgtatttgaatattttgttaatggttgaatttgtattagggttattgtgttagttgggtttgttaggttatcgttttcgagttttgtttaaggtagggttagtgtttatattttgtttttttgttagtgttttatttaaggttttggaaaggttttggagttagagattcggttaaattttggtaatgttttatatttgttgtgtgattatgggttagcgatttagtttttttgtgtttttcgggttgttgtgagggttataggagatgtatagagggttttgagtttggtggttggtatgttgtaaaggttagttacgtggtgtaaggatggtattgatgataataaatgaatcgaacgaaaattaggttaattgggtttggggaggggcgttggttaaatagattcgagtggattaggattttgtatatgatgagtaagcgggaatagttttaaatagtaagtcgggtaggtttaggatgatttagttttgggtgttgtttagggttttttttcggtttttttgtcggtttggtttttttttgttttagtttgattgtttttatgggttttaataagtttttgattaggattgaggtagaatagatagggtttaagattttgtaggtaggtatagagtgtggatggtaaaaggagatgttttaggttttttgtcgttttttttttttcgaaggttgataatgttaatttatagaagaagttgtttttttcggtttcggattttattttaatatagtgtatgaggtagttgtgtttaaggggtgtgattatttttgtagatggaatttatttattgtgtttagtttattgttagagttcggaggacgggggaagtgaggtggggtattttttatagtgaagggaaaatttagtttagttatttttttttgtgttgtttttggaatttattttgttatggttttattttaatttagttttttaaagttttagagagttttgtttttttttttgtattttatttcgtttatttgtgttgggttagttttttagaagtttcgttttttgttatttttagggtattaaggttggttggtgggtttagggatttttattttttgatttagttttagtggtttattttatatttatcggtatttataggtgtgttttttattttcggtttttgtataggcggttttatattttgggagtttagttttttttaaggatttacgttagagtatagggatttttgtttttgatttttttttagttttaattacgagtagtttatgttatagtaattttttagttgtttgtagttgtttgttaagttatgataatggtttttgttttttaatttaatgtttgtatatagataaatcgttatattttaagtagattagatattattttttttaggaagttttttttgattgttttagttggatagaggttttttttttttgtgtttttttaatgtttaataggtatttattgagtattcgtgatatgtaaggtatttataatataagttagtgttttttgtttttttagagggtatatgaataaataaacggtaagattttttaatatttatttatgttttatagaaagttatttataggtatgggagggttgttttaattgcgggtgatagggaggtttttttaagatggtagcgttttagtaagatttgaatgaggcggttaggaggtttagggagggattttttaggagggaataagtgaatattttttcgtgaggatgagtttttatgttttaggagtagttaggttaggggatcggtgtagtgaataggggttgaggggagtggttaggtgacgtagggttttataggtcgttttacgatgagttagcgttttaagtatagtagatatttagggaaggtttaggttggggagtgatttgaatagattttttatttaggagtttatcggggtttttgggtttacgttgttgcgttattgtatgttttcgggggttcgggggggtattttttatattattattataggtagtatttttgggggaggtgtgttgtgtaggggattcgttggttattttgtcgggtaaattataggggattgtgtaggataggcggttagtttaggagggataattatttaagtaggggttagagggtattcggattcgggaggagtgtttaattttttaggtttaggtaattagaggtggggggcggggtgttgttttttgatatgggaggtttgggggtttggttgtattttttggtgtggaggtgttgggaggtgtggaggtttttttttgaggttgggattttttggttattttgatttattgtttcgattttattttttagtttgagggtatggtttgaatttatagtcgtatatatttttttttgtatagggttttgcggggtcggtatagtagttttttttttatagattaggatgtttagttttaggagggttgggattgtttaagatcgtataattagggttagatatagttgggttaattttgtgatttttggttttacgtatagattttaagtatataggtaaaattttgttggttgggagggttggggggtagatgagcggggggtagtttttttttagttttttaatatgttaggtttttgggtgggagggggtataaagattttattttttttaagagatagagaaagaggtagtggagggtttttttttggttgaggttttaggttttgagtggtgaatgtaattttatttggaggttggaagttaggcggttttgggggtgtgcgaggttcgttagtttagttgtagttttttttatgtaagggaattttttttaggtagcgtttttatgattagagagggggttaggaagaggtgagggttgtatttagagtgatattcgggtgggttttattttggggatacggttatatttttttttcggatttttgaagtttttaggtgcgggttaagggtttttagttgtaggtaggagagggttttatagttatagatttggggagtttagtttgtaaagtttagaggttttcggaggtcgttggttcggttttttgtgtagttgggtttttttgggaggttttttttcggtatttttagtttttagttcgtacgattttttatagttgggtttatttttttaggttcgggttatatggtgtaggttagtggggttttgggggagggtagggcgttaggaatagtttcgggggtggggggattggagtagagtttattttggtcgtttgtttattttgtatgaaggacgttagatttttatatgtggttattcgatttcgtttaattatgcgtaagttttggttatttttattttattgatgggaattaaattggttaaggagaagtttagaatttgagtagagtaggggtttaagttttttaggagttttaggtattttttagttttttttttcgagtattgagtttatatatttagtgttcggatgtttatttatttgggggttcggcgatcgttagttagtatggtttataaagggtttttgtgtaataggttttatttgatttttttaaaaatttttcgaggtaggataatgttatttaatttattttatagataaagtaattgagttataaaatggtttgttaaaagatatagaggtagaaagattaatagtaaagagtttttttgtgattttgattagtaaggtttttagaaaaaagtaagggatttcgaggtttttataggaatagagttttggaggagaataagagtttagttttatgttatttttaaggggtattttgaaggttaaggtattgggtttaagtaggttggattgtgttttttgtattttttttattttttgaagtttttttttttttatttaggtgggtcgtggaggtgtttataatatataatggaatagttggtaggttattgggttttttattgagttaaggggttcgattagaggtttaaatagtggtatagaaattatgagtttcgttgtaaattagtttaggttttggagttaagtagttttgtgtttatagttagggttagtcgtttttagttgtgtggtttgaggttagttttttaatttttttgtgtttcggtgttttttttgtagtagtaataggaatcgttttttacggcgatagtgtagatatattttatgaagcgtataaagtttcgagtttagcgtttggagtacgttaggacgtagtaagtggttatttatgatttatgaaatattaataaggtgaggggtggaatgatagtttttttgcgttgtttttaaaatggaaataaatttgtttagcgtttaaagtagtagaaagtgagttaaggataggtttttagcgatatgttttggtagagtgttttttgttggttttaggtagggtttagggcgggcggttattttttagatgagtttatcgttggtatttgtttttagagtatatgtttggattttttagatttttttttttttttttttgatttttttttattttgtaatttttattttttgttatttttttatttattttttttttttatttttgtttaaaaataaataatggaggttaaatgtgttagttggttttttggaaaggtttttttgtagtaggaacgcgacgggggtagtggaggattgtttagcgtaagttacgtgattttcgcgcggagtcggggaaggggaggcgttgagatcgagggtgttaggatcgaggtattgagatggggttattggataatggttagggttagttttcgtttttattttaataggggtttttatatttaggggttatatttttaaagttttttggataagagagataaattttattatagggttagaaacgttgtttttaggtcgttatttgggtgggggtgagagatgtttcgtcggtttttaaatatttattttgtggataaaattattaaggggaatttaatgtttttatagtagtttggttaagatataggtattaggtcgggcgtagtggtttacgtttgtagttttagtattttgggaggttgaggcgggcggatcgtttgaggttaggagttcgagattagtttggttaatatggtgaaattttatttttattaaaaatataaaaattagttaggtgtggtggtgtgagtttgtagttttagttatttaggaggttgagataggagaattgtttgaattttggaggtggaggttgttatgagtggatattatattattgtattttagtttggatgatagagcgagtaagatagttttaagaaaaaaaaagatgtaggtattgttttagggtttataagtataatttgatttttgatgttggtatttaattttgatgtagattttagtaggaaaagggagacgaattagaaggttgtggggacgaggggtttatagtagtgtttattagatttgttttggtaggtataagtgttttttggaggttgttagataagtagagggtttattttagagattttggttttggagggttgggttagggtttaggaagttgtatttcggtagggaatttagagttattttgagttttattttggaagtaagagttagggggtagaatagaatcggaattaaaagtttttgtgggtttagttttatggggatgggttcggttttatggggatggatttttgtattattcgaggtgattattagttcggtttttcgggattagttttgagtgttttttggggaaagcgggatttgtagaggatggttttttaggattcgtttgattatttatttttagttcgtttttattttagtttttttgatttttattttttatttagaattttggagatttggttttggaggtttagagattagaaatgaggggagataaggggagaagtttttttttttattcgttggttacgttaatgggttgattttttaggaagttatattagttattgttattgttttggtcgtttcgtttggtttcgaggttgggtgagtaagtatttcgttttgtttgtttttttatttgagttttttgttgatgttacgagaggtttgattacgcgtttaggaggtataggatagagtttagagttgtttaagaatatataaggttgaggttcgggttttgtatttgggaagggttaggaagggttaaaggaaaattttagttgagtataatggtttatgtttggaattttagtattttggtaggttaaggtaggaggattatttaagtttaggagttggagtttagtttgggaaatatagtaagattttatttttataaaaaaaaattaaaattaaaaaattaattaggtatggtggtatatatttgtagttttagttatttggtaggttgagatgggaggattgttgagtttaggaggtcgagattatagtgagcgggatattgggttattgaattttagtttgggcgatagagagagatcgttttaaaaaaaatttttatattttatggagtttagtagaattttcggttagggtgtttcgattgtgaaatgagcgtggtagttgttaattttcgagggtgaagatttatttattagtaatttgtattttggtacggtgagaggaagtgtttggggaaagacgtcggtcgaggtagagagtttagtttaatttatcgtggaggagttattttagttttaaagagaaagattaataaattttaggtgaatggtttaaaagttatttttgtatacgtagagggtgtattttgggatatgtggatatttttttttaggataggaagtaaaattagtaggtagagacgtgagtttttttgtttttgtcggagttaatttggagtttttatttcggtttttagggaagtatagatttttatttttatcgtagttaaaagattttttgttgatttttttagtagtatttagtttagttttgtggggagaggcggtagggggaggagatagagaaagatgagtttttggtagttgtgattggggggagagaaatgcggttttaatttgtttttgtttattttatagacgggcggtgttttattttaaaatttagggtagttgagggattgaaggaagagggggatattttttaattggggtttttttttattttattttatggcgttttatataggaaagagttggaaggtttcgggtttttggtatttagttaaagttttaggtaggggtttagatattgggttgtgttattattttaggtagttcgggagttagcgacggtagagttttatttttatttcgattattgtatagtatttcgtttttaggatagtttagtagttaggttgttttagggtttaaatttagatatttaattgtgggggttttaggtaagtggttgaagttttttgcgttttgattttttaatttggaaaatgggatgatgaaagtaattgttgggtagggtaaggggtaagtgaaagttagcgtttgagagtgatgtggttaggatcgttgttgtgattatatattgagttttttttttttatttgagataagggttttattgattgttgttagaaagatttagatttagaaggattaggaaagtcgttttatttataattttagagggaaggggaggttttcgtgttagttggttgttgtaggggagagggtgggagatagatgggggatagaggagtaggggtagtaggaggaacggtcggtagggaagttcgtttgagatttaaaggattgtttattaggaggatagtttaggttttttttattgagaaagatttttttggatagttgggttgaggatttttaggttttttgggtggagtagaattagttattattgaagttatataggtttgtaagtataagtgggggattgtttaggtatttttgttttataggggttaggtattaaggttagggtggttagaggatatgacgtagtttagtaggggtttcgtagaattattagttaagaagatatatgtagaagtacgtaagtgtttcgaggaggtaaattttttgttggattgaatatggggagttgagtttttaattattgagtcgggttgttcggttcgtttttttttttttgaatagaaggtttttagatagagtagttaggtaatagtatggttaagtaggggtttgtattttagttttgttttgtagtttgattaggttgtcgtttttttaggagatacgggattggttagggtttttttaggttgttataggaataaggtagggttgtgattttttttatggtttaggtatttgggggagggattatgagttttagtttaggggatagataggaaacggatagttcgttttttttttaattacggagttggttttttttttatcgtattttttttagttatgttttttattagaagattatcgtatttaatgggtggttttgtagcgatatttagtttaatgaagttatttggtgggggttttgggggatgtagttttttgaaatatatacgggtagtgggtgagtcggaggttgcgtggggttttgttttttggggatggttaggaggtgttttaattatttgtaattcgagtttatagtgatcgggatttgttgtttttttattttagtttttttttattagtattcgttaagcgttagttagtaggtgtcggtacggtttaaggtaggtttgtagttagattagtatcgggggagggatcgggagagagatttttagagtggaagttatagttttttttttttttaggttgggtaatagattattatttttagttagttttggggaagggggaggggttagttgggtcgtaggtatagcgttggggttttttgaggtggttgttgttgattacggttttttttttttttgggttgggtaatagattattattttcggtttattttagggaagcgggaggggttagttggggtataggtatagcgtcggggtttttgcggcggttgttgttgattacgggtttgttattttttttttagttgggttgttatttcggttttgaaagcgttttttttagtttttaattcgtgtttaggaggtagtcgatattttaagcgttgttatagtaggaggttgggtttgtaagtgtgattcgtttggggaggggtagagggaaagattattttcgtttaaatagcggtttttttttttttttcgggggtttttatagggtttttagtttttttttggttaagaggtaaggagaggtaggaaagttttaggaatatcggtagagaagagatagggtaggttgttagaggaagtaggttgtagggtgtttaaggttttaggttgggttttgggaggttagggtatgggtaattaggaggtttaggtagggaaatttgtttcgtagggattttgggagataggggagaggggatatgatagtcgttttttgttgttttttggttgtggtttttaggggttttagtttagattagaagtattttatgtatcgggtttcggtttagtttggaagtacggtttatagatttatatgattatttgggtagtgatttttaaaaggtttttcgttattagttggggagttttcgaggggagggtggttttgtagagtatttggagatattaatgggtcgtgaggaaaggaggaggcgtggatatttttacggttttaagagaaaattaaggtagagttggaggttgggcgtggcggtttatatttgtaattttagtattttgggaagtcgaggtgggtagattatttgaggttaggagtttaagattagtttggttaatatggtgaaaatcggtttttgttaaaaatataaaaattagtttgttatggtgatacgcgtttgtagttttagttatttaggaggttgaggtaggagaattgtttgaatttaggaggtggagattgtagtgagttaagatggtattattgtattttagtttgggtaatagagtaaaattttattttaagaaaaaaaaagagtagagttggaggttaggcggtttttagagtttgataaggaggtcgtggggttgggttgttttttcggttatttgaggggtagggattggtttagtttgagttttagatttataagaggttgaatcggagcgggatttcgagatgaggtagggttattttgtttatatttgtgtttaggttttaatagttattttttttaggaatttagtttgatggttttttaggttgagaggttgttaaggggttgtaaggtgtcgtaacgtgtgagtcggtgggttttgatgtgtgatagttcggggtattttttttatcgttagggaataggaatgaggagttttttatttttagtgtttggtaggtaggaggtcgttattggattgtgtgtttaggtgttattagatttcgagggtttacggatacggtatatgatttttaatgattaacgtttgtgtagtaggtgttgaggtgttttaatttcgagtaaggttgggtttttggaatttttttttcggtaggaggatttgtagttgaggaatttttaagaaattttttggtagtaaataaagtatggggttggacggtggatttatgagtgtttttatatgaatgcggatatagatagaaaagacggtaaatatttgtgaataaaaggaatggtttttgcgtattgaatttttatttatcggtttttgtttggtataaagtttttaggaattttttaatagttttagttagaaacgtgtttttgtttggttatgtggaaaattttatatatattaagatatatgatgtttttggttttttttacgaatgttttatgttttttgggtttatgatttggaatttgtagatttttgttgtttttgttttagagttataaggattttggatgtaggaaatattttttatgtgtaagggttttttttttttttgttagggtttatcggtttttttttgtttataggtgttatttaaatttttgtatttgtggttttttttttttaattatttcgtgtaattcgttaatagtttttttatttttagagtttggttgttggagatatataaggtatatagaattcgtgaaatgatattgagtatttattaggtatttattgtgtgtttcgtttggtaataataagtaaaattataatgttttgggtatatgagtatatttttttatgtttatttttttagtaatttaatgagatggttttataaatggggaaattgaggatagggaggttagattggtttaaagttataggttaggaggggtagggttaaaatttaaatttagatagtttggtattaaattttagttttttatacgaaaggtattttgtaatttttcgagaaggttgggattattatttttattgtatagatgaggaaattaagatgttaaatggttagatagttttggagttaggaggtgggtttagtggtttatgggagtatatggaatggagtttatgggaggttcgaggttgggatttcgtattttattttggtttaagggatgaggtgattgggagtgttagagatattttgggattggttatttaggtgttttgtatttagttttagcgttgagtgggcgagggtggataatttgttatttagtagggttgttgttcgtatttcggtggttttttaaagtttggttaagtaaagtaagattgttttcggattagagtgatttttaagttatataagtatttagttatgtttcggaggatgtaggattgggaaggttttttttttatcgtatttttatttagtttttttatggggtagttggttttaggtatagattagacgtttttttttttgtttgttgtcggtatgtttttggttttattgttgttttagggaggggtttaagagtttttcggtttcgttatttattatatttcgtttagagggtcgggggtttagtattaacgttaagtatttagtagtaaaattacgggttggaaagagttatagtgttgttttgatttggttttattttatatcgggtgtcgtttttattagtttttttttgtttttggttttattttttaggtattataagttttgtaggtttaaagttaaatttattagtttttgattttttttagttgggattagggtgaggttttcgtttaggtgtaaaagttaaggtagtgttaaaaaatttaggaattaaataatattttgaagtaatattttaaataaattaaattttacgttgaataaattttgatagggttgtgtacgtgtagggttgggtttgttttaatttaaaattttaatatttgtttattatagagattattatgtattatttcgatattgaaaaatattgtattaaatattatttgtgttgatttttgagttttttggtgtttttttatattttgtttttgataagtgtttgatatattttgttttagtcggttttgttttttaggtgtttttttggggttgttttgtttacgtttttcgtagttattaggagttattgagttattgtatttgttttattttgttttttatgttttcgtatcgtttatttcgttatgtttttttcgtgtgttttggtcgtacgttagttttagataggagttcggtgggttgggagtttatattaatgttgttttttttcggtttcggtgtcgggtatagggtagtattggagatttttttttttttttttttttttttttttttgagatatagttttattttgttatttaggttggagtgtagtggcgtaattttggtttattgtaatttttattttttaggtttaagttttgttttttggaattaagtagatttttttgttttagtttatcgagtagttgggattataggtatacgttattatatttagttaatttttatatttttagtagagacggggttttgttatgttggttaggttggtttcgaatttttgattttaggtgatttgtttgttttaattttttaaagtgttgggattataggtgtgaggtattacgtttggtcgagattttttgaataaataaatattatcggtatggagattcgtttagggaatttgtttagattttgttattgtatttttgtttgttgcgtttagaggtaatttagggtcgttttagtcgtttttatttggttattttttggtttttatttaggtcggtttgttttattttgtgggttaagaaaacgatttagtgggtggtgattagtattttttttttaatttgaaaagaatatatttattagcggtggtagtaatttaatgttttttagttgatgaaggtaatatgtttgtttataatggaatggtttatgttatggtggaatattatttagggacgtattggtatttgttataatgtggatggattttggaaatatgatattaagtggagaagttagatataaaggttaaacgtgtaattttttgtataagaaatgtttagaatcggttaggcgtagtagtttacgtttgtaattttagaattttgggaggttaaggtaggaggattatttgagtttaggagtttaagattagtttgggtaatatggtgaaattttatttttataaaaaatataaaaattagtcgggtatggtggtataggtttgtagttttagttattcgggaggttatggtgggaggatggtttgagtttgggaggtggaggttgtagtgagtagagattgagttattgtattttagtttgggtgatagagtgagattttattttaaaaaaaaaaaaaaaaaaaaaaagaatttatatagataggaaggaaatatggaggaggagggtaggattgatagttaaaggttacggggtttttttttaagaaaaaaattttttaaattttttaaatttttaattttttaaaattggttgtggtgacgatggttgtattattttttgaatagattgaaaattatggaattatgtattttaaatgggtggattgggttacgcggtgatttatgtttgtaattttagtattttgggaggttgaggcgggtggattatttgaggttaggagttcgagattagttttaatatggagaaatttcgtttttattaaaaatataaaattagtcgggcgtagtggtatatgtttgtaattttagttattcgggaggttgaggtaggagaattggttgaatttaggaggcggaggttgtagttagtcgagatggcgttattgtattttagtttaggcgataagagtgaaatttcgttttaaaaaaataaataaataaataaattggtggattgtatagtagtttatttggattttaataaagttgtttaaaaaaaaatgaaaaaaagttttttttttttttaaaataaataaataaaaagaaaaaaagagagaggggaaaaaaaaaaaaaaaaagaaaatattgagtgtagtatacgtatggtaaaggtaagaattttattacggaaatttggttttattaatatattttatttttatttttattttatatataggtgtgttttggttcgtggtgttaatcgtatgtttttttggaggttgtagtttagattggttttgaaagttgttttttgggtaattttaaattttttataatttttgaagtttttggtttgttgggattatttagttttttagatttagtttcgttattatttatttaagattgtagttttggggaggggggtttttttttaagggtgtaggggttttgtggttttatttttttttagaatatatattattttgtattgtatatatgtgttttaatatggagtattttaggacgttggttatagttagttatgtttgtatatcgattgatcgatcgtgttttgttgattaattatgttaattatcgcgttgtatattgtttttattaagcgagttaaagtaattttttcggaataagttgacggattttaaataagttaaaagatatttttttaggaaaaaaatagtaatgaattttaagaagaaagaaaaatttttaaatttatagatttatggaaaaagtttaagtttttaaagtgttagatttttttaaaagtattaggtttagatggttttacgagtgaatttttgaaaagttttaatagagagattattatgttgttgtttaaaatgttttagaaggtagagggtaaaagaaatgtatttaaattgtttttgttaagttagtataatgtagatattaaaattgataaaaatagtatatatatatatatatatatatatatatatatacgttttattcgttttagattaagttcgttgttgtgtatttaagtaatattatttatttttatttcgttgttgaaattaaaatatattttaatggatttatgattttaatatgtaaaaatgaaattatagaagtattagaagaaaacgtgggtgaaatttttttttataattttagaacgtaggagatttttaaataggatgtgaattttaaaagttaaaagggaaagtagagatttgataatattaggattaaaatgttttgtgtagaagaatattttagaaataaaattaaaagtaggtagttggggataagatattcgtatttgttgtgataaagatgtataaataatttttttttttttttagataggattttattttgttatttaggttggagtgtagtggtatgattatagtttatagtagttttaaatttttagatttaaatgatttttttatattagtttttcgagtagtcgggattataggcgtattattttatttagttaatttttgtagagatgcggttttgttatgttgtttaggttggtttcgaatttttaagtttaagtaattcgtttattttagttttttaaagtgttgggattataggtgttagttattacgtttggtttataaagaattttttttaaaaaattttaataagaaaaggatatattttttaaatgaaaagagaatatagggttttggtttataatatacgaagagataatttttttcgtttgatcgagatgtataaaataaaatattaattggagagtatttggtttttagttaggggtaaggggtataggatttttttgttggattattattgtatagggtttagtagatagttgagtaggtcgacgaggggaggggttttaaaaaattttagtaattattttagaggttaatttaggaataaggattaattttttttttttttttttttttttgatagggagtttcgttttgttatttaggttggagtgtaatggtacgattttggtttattgtaatttttgtttgttgggtttaagtaagttttttgttttagttttttgagtaattgggattataggtataagttattatgtttagttaatttttgtatttttagtagagatggggttttattatgttggttaggttggttttgaatttttgattttaagtgattagttcgttttggttttttaaagtgttgggattataggtgtgagttattgtgtttagtagattaaaatttaaatgtatatatttttgatatagaaatttattaagagtttattttttagttatgtgtgtatatgtataagtgcgagaatatttgttgtagttttttaattatagtgggaagttggataagtttggtagggttatgggatagttgatgatataattattaaaaggaacgtgttattttgggaggtcgaggtgggcggattttaaggttaggagtttaagagtagtttggttaatatggtgaaatttcgtttttattaaaaatataaaaattagttaggtgtggtggtaagtatttgtgattttagttatttgggaggttgaggtaggagaatcgtttgaaagcggaaggcgaaaggtggaggttatagtgagttatagtgagttgagatcgtattattgtattttagtttgggttacgttttgttaaaaaaaaaaaaaaagaaaaagaaaaaggaacgtgttatatttataagtggtaatagtgttgttaaatggaaaaaataaaagttggtagtagaagtttgattttttttgtgtttttgaaaagtttatatttatatattgattttttttatataagttttgaatgattttgtaggaataaaatttaggagaatgttatatttagttgttaatatggttattttttgggagagagttggggaatgggagagaaaaatttttttttaaattttatgtgatttttattttttatttaagaatgattgggtatcgttttttttttttttttttagatgggagttttgttttgttgtttaggttggattgtattggtataattttagtttattgtaattttcgttttttgggtttaagtgatttttttgttttagttttttaagtagttgggattataggtgttcgttattacgtttcgtcgtgtattgttttttaggatgaagaaagggaaaggttatagggagaatgggagttagaatatagagtagggtttttaaatattagtttgcgggtgagagagatacggggcgatattatcggtttggaatttagggatggtatgaggtgttgtttaggggttttagataaggtttgtttgttgattaagtaagggttgtgttggtttttgtttatgtgtttgtttaatacgaattttttaggcgttttattttgttttacgaattattattgtttattttaattacgttgtataggaagaattgtgtttatttttataatgagaaaacggattagagaggaaagttattaggtagggtaggggcggtagtttaggtagtgtgagggtaaagtcggtgtttttttgttatttttttatatacgagtgggtaaggtattataggagtttatattttaatttttgcgggttattttggaaggcggtagatggaattagtgatttttagggttatttttagttttaggttttagataggggtcgtggagtggaatcgagtttgatttaggtgtgttgatggtagttatgtaattgtggataaattatttttttttttatttgtattggatgagatcgggaatttttattttgggttttttaagagttttggggttttatagagtatatttagtagtagtagtgggatggggggatagggttaggggagttttatgttttttttaattttaattagagtatttttattttaatttttttttgggtttagtgtttagagagaacgggaaggaagtttagttttggttatgggttattttagtttgttagttatagtttatattttaggagttttttttggattgaaggagatagagttatttataatatttatagaaaatttcggagaggaagtggagtttaattgaggaagcgtttttttgtagtttttagaaatgaggttataggtgagatagtgtgttagggtggattatatggtatttttttaggttgtttgttggaatttagggtttggttaggggttgtttatattttgggtttcgaggcggggagtttgagtgcgtttttttagggttgaatgtgttttttgtttatatcgtatagagtatggttgtttggtcgcggcgcgttttttcggataggttcgttattgtgtagatttttaatttcggtagttgtttcgggtttgggaggcggcgggtatagatatagttttttttttttttggtagttgttttgattttttgggataagtgttgagaggcggttttatttagtgttatgtgtttgggggtcggggttttattttggggttaggttgggtggttagggttatagagttgtagggggcggagtagagaaatcgtttttagcgtttgttttttggttttattttttttcgtagttgcgttttatttaaggtattttatagttgttcggtattcgttgtattttcggattagtttttttttttttttattattgtacggtgtttggtaggtcggcgaggggaggggttttttttttgggttttggagttaggttttgttttttggttttatttcgttttattacgaaggagatatatcgggtttggttaattttttcgtattgatttttgtttttttagtatatgcgggattttttattttagatttaggtttgagaggttttagggatagttcggagaaggagggtatttgtttttagaaggggaaagagaaagagatttaattttaaagtaaaaggggatttgggtgttttttgtaagtagtttaggaaaatgggaggaggtgggagtagcgggatttttcgagtaaggtatttcggtaggaacgttagtgttttttggatatttttagaagtagaagtatatagttttatagaaaaattttgtaggtttaggattcgaggtatgatacgatttaaatttattgttttattagatattagtgagtttttcgacgtttattaaggttttttgttttatatttggtattggacgaatttgtatattttgttttagggagtttatagtttagggataggtttagagtttatgtggggtgttttgtaaatacggggttagaagttgggttgtttatggggttttttttttttaaattatagtggttattttttttttaattttatagtttttgatttttattaggaatttttggggtttagtaggtgttttttttttgtaggttgatgttcgttttttttattttttatttaggtttagttttgattttattttttttaaagttatttttttattgttttgtgttgggtggttttagggagttttgtgttttgattaattttatatttaacgttgtattggtagttttgttgtttgtgttgagatttttttttgttttgtttttggaatatacggttcggtgcggattaagtatgcgaagagttacgtttattattattagttcgggggggtttgattttttgtttttttaacgttttatttatatgataaagatttttagattttttgggttataggaaaattattgagatatgttgttatgtttatttcgttttaattttatatttatgtttataagtggttttagaattattgtggattttttttttggtttttggggtgggtggatatatgagagtttagtttttagttatttttgtagatgtttttttgatagattaagaaattgaggttgggaggggtggaatgatagtttagaattagttgatttatggggtagagttgggatatgtttagaattgagttgggtattgggtttggttttttttttgtttttagtgagtattttaagaaggtagagaattagatttatgaacgagcgttgagtattcgttttataaggtagttttggagaaatttggttggtgtggttgaggagtcggaggggggtaattttggtggggggggttttgagttagtagttagtttttgtaggtttagtattgggtgttgtagtttagttttattttattttatttagaggtatttatgttggggggtaggaaaagagtagggatttaggagaggaggtaaggtcgtttttatttagagtttgagaggattagggatgattttaaaggatgagcgtttttttgtgggaggatagtaaggagggtgttaagtttaggggtagggttagagtttcggaaatcgagaatttattttattagtataaagtttagattttattaggttttggggcggaggagtaggtagggatgtttttgttttttgtagcgttttttttttttttttttttttttaattatttaggtgtttatatttttttttgaaatgttgattttttttagaatttttatattgaagttaatatttatttattgagttttttagtataatttttagaggagagattaggtgttttgggggtaaagttgattaggaaagtttttgtttggtttttagggacgatttatgggggttattatatttgtttataagaattataaaaaagttattttaatttattattagtggtttatttttttagtataattttatggtatatttattatgtttaagttatttatttggtattttatgggattttttttttttttttttttttttttgagatagggttttattttgttttttaggttggagtgtagtggtataattttagtttatcgtagttttaattttttatgtttaggtggtttttttattttaatttttttagtagttgggattataagcgtatgttattatgtttggttaattttttgtattttttgtaaagatagggtttttttatgttgtttaggttagttttaaatttttgggtttaagtaatttgtttgtttcggtttttaaagtgttggatttataggtatgagttattgtatttggttttttatgggattttttataaaaattaagataggttgggtacggtggtatgattttagtattttgggaggttagggaagttgaggtgggtgggttacgaggttaggagttcgagattagtttggtttatatggtgaaatttcgtttttattaaaaatataaaagttagttaggcgtggtagtttacgtttatagttttagttattcgggaggttgaggtagaagaatcgtttgaatttgggaggtagaggttgtagtaagttgagattatgttattgtattttagtttgggtgatagagagagattttattttaaaaaataaaaaataaaaaaaaaatataaaaaaaaataaagataatagttttatttttagaatttagtgggggtatgaaaggaattttgaagattatatagtaaaattttaagtatggatatcgttggtttataggtgaattttaggtttttttttatttttgtattttttgtattttaaagaaagggtattcgattattttttatgatttgaaaaattatttttatatttaaaaaaaaaagtttagtagaggaaagaaagtttatatataaattatttatattttaagttaaatacgaggtatttggattaggttttgagggatgtataggagtttattaaggtagtgatgtaaagagaagtagaggttagggtttaggaggttagggtaaaggggttgtgaggaaaggtgtgagagattaagggaagattaaagtaggagaagttgggaaggagagaggtgtgagttgagtaggagagtgaattaatcgtggaggggtttatggtgagtgagtagagaaggtttagtacgggaagagattttagtagtgttgtgttttggggaagttagtttgggagtaatttagttggggttttaggagattttgttttgtatttatagttttggggtggagataaattatagtatagatgttttttcgtaggtagaagttaaggggttgggcgtttgtttagagggtacggaattttttttatgatttttttttttatggtgttagttggatttttggtgttcgggggatagaggggtcgtagagattggttagagttgtgtatgtcggggtttagggaatttttagtttagttttatatggaggggtagaaggggatgggtttgaaggaaagatgggtaggaagttgagttggagagaattggattcgtgtttagaacggtcgtgatatagagagggaggacggagaagtaagtaggtggtgtttcggaggaagaattagtggggtttaggtttgggtttttcgagaagttatttttatcggattttaagagtatttttttattgggaaggttttgttttcgtttgtttttgtattttttttatttggatttgtttaggtttttaggattgttagtttagtttacggatttttttacgtgagttggatttttatttgtataggtttttgttcgtgggtggtcgggtttgggatgttgatggtttttttttatgtttcggttttaacgtgtatattttattttatggagaaagttatcgtttttttagagcgttaggtttttggtagttttgaacgttgttgtttttacgtggtttgttttttttttttttttttggtttgatgaaattgtatttttattgttggggaagttttttggatattttttgtgttttagttattttgtttacggttcggtgagttttagaaagtagagttcgtaggttgtgtttttgggtttggttttcggtatagtttttggtataatttaggggttaaattgtgtttgtttttggaggagaatgtttttgtatatttttatggatatttttttatttgttttttagagttaggattacgtttttgtgtatttagtattagttattatcgagatttagatggttcggtgataatcgtttttttagttatattttgtttgatttagttgagtgtgaatatattaatttaggatgggggtgtattcggtacgttaaataaaggttttgtattaatagaaggtaggggaggaaatagttttttgttattttgtaaattgtttatgtttttggtttgatattatgttattagtaattattgttattgagtttgggtggttggggtagggtggttttttagagttaagtttagagagatgggagagggaatacgggattcgtatattgagggtcggaaaggattttttaaggtttattagtttttggttatttagtgtgtttcgatgttttttttgtaggaaatgtagagttttaggttttagattcgttaagataaatgtgtattttatatgtttatgaaagtatgaggagtattggtttttttttaaatttatattttttttaggttttatatttttttagtttttaagtttattgattattggagaatttttatttaaaaagaaaaattaaaaaggggttgggtggtttatgtttataattttaatattttgggaggtcgaggtaggaggtttatttgaatttaggagtttgagattagtttgggtaatttagtgagaatttgtttttataaaaaaaatttaaaaattagttaggtatggtggcgcgtaatttgtggttttaggtatttgggaggttgaggttggggaattatttgagtttagggggtagaggttgtagtaagtagtgattatattattgtacgttagtttggaggatagagtaagattttgttttaaaaaagttaaagaaaagttaaagaagatggaaagagggatttagagagatgtggaagtaatttaagggtttatcgatggaggaatagttatataatataagtgtatcgtataatagaatattatttagtttttgaaaggaaggaaattttgttttatgttatagtacgacggatgaatttttaggacgttatgttgagtgaaatgagttagatataaaatgggtagttattgtatttttttatatatataaggtttttagagtggttaaataaatttataataaagatagaaaatagaatggtggttgttagtagttgggggaggggtatggggagtttggtttaacggggacggagtttagtttgggaggatgaaaagggtatcggagatggatagcggtggtagttgcgtaatatcgtgaatgtattgaatgtcgttgaaacgtatattgtaaagtggttaaaattgtatattgtatgttgtgtattttattacggttagaaataagaagtagtagttaaattaaaaatttagattgtgttgtttgtttaatttaaagaaggtttattgagtattattgagttttgattttgtgtttagaattagatttggtttttgaggggtttttaatttagttggtattttattatagttttatggagttacgatttttgttggggttagggggtacgtttttgagaagggatttaattatgttttatagtttggtatttttaaataggttttgtgttttataggattggtattaattttttgtttgtaagttttatgttagtacggttgtgggtttgagtttttttaggacgttgttggagttttatggttttttttttttcgttagaagggtatttttaaataaaatcgtgtgtagttattatatagttttttggtttaggtatttttttttagtgttttgagaattttgttttgtaggttaaggtgttttttatgtttttttttttttgttataattattttttttgggggaggaggattagattatgggttttaatgtaagttttaggaggtatacgtttttttttttttttttaagttttcggtttttgttgggtatatttaggtagtttgtaattttttaagtaggagttattagaatgtgatagtttttttaggggttttaattttattttgttttatatttttgtatgagtttgttttggtttttgcgtggttttttattttttaagttttttaggttttttagggatatatagtagatagaggttttagtaaggtttacggtgatttataaaggaggttttttgaaatttagaaaatttttttaaatttttatttaagtttcgtttggggtattttggtatgtttttattagatagagagagttattttttttgagtttgtagatttttatttttatgtatttcggtttttttgggtttttagggtagtattttttattttatatttagtttttttttttaagattttgtggtaaagttagtaattaggttttttattattatagtatttaagatttagcgttttgcgatttatttttttggtttcggggtgtagttttagttatagggggttggggtttgggttttagtttgttttgtagttgagatataggggtaggttttgaattttttaaggtttgggttgggttgggggcggtgggcgttttagtaggtttgggtatttggatttttatttttttgggggttgcgtcggtggtaggggtagtgggtatttcggggattttggaggtagggggttttatttttcggtgggttgatttttggggtttgacgatggtgattttcgtttttcgaggggtcggttttggcgttttgtggtttaatatttcggtttttttgagttcgaatcgggacgggtcgatggtttcggcgttttttatttgtttggacgagatgttaatggatagtttagtgcgtcgggatatcggttcggtcgttttggggttcgagagttttatttttcgtagggacgttttgggggagcgttggtttagggagtttatatggcgggtcgagggttttgagttttttacgtttaggttttggaatttttgggtggagttggttatagtggttcggagtaggggagtttggatttttcggggtggggtggagttgggtgtttcgattttttcgattttaaaagatttttttaaggttgaaaaataaagagaggggatgtaattggtgaatggatggttagggaatatttcggtatgttttttgttaaggagtagtagaggaaggtaggcgatgcggcggtgagggtcgggggttttttttcgttttttatgttttagtaagcggaagggatagttttattttaggagaattattatgagttttggggtagagatgtaggttggagtgggaagatgttgttcgtcgtgttttgttatggttacggcgtaaattatatagtttttttttttagttacgtttatataggaacgttttagttttagagaagatttttatttttttttttttttttttgagatggagttttgttttgttgttttggttggagtgtagcggtatttttcgggtttaagcgatttttttattttagtttttttagtagttgggattataggtacgggttattatgtttggttaatttttgtatttttagtagagatggggttttattatgttggttagtttggtttcggatttttgattttaagcgatttattcgtttcggttttttaaagtgttgggattataggcgtgcgttatcgtgttcggttttgattttttttttgtcgcggttgtttttatttttttttatttttagttaaggtatatattgggatattattagtaaatatatttttattattagttatagcgggggatatgtttttaataataagtgatcgtaattgtaattaattagaatcgtagtaggaataaaattttattaatgatattaagggcggatattggagtttttagtgtcggcgaggcgtcgggtttatcgagtttattatatttgtagtcgtttaattttgggatgtaaagaatattagtatttttagtatagatggggaaagtggggtacggggtagatatagagttagattgtatattaggttgatattagagtttaaggttttaattatttggttgttcggtttttttagtttagtttataggaattaatttttttagttattagttttttttgtatttttttatttattattataagttcgtgtagtgatgttaattattagttttcgttttgtagttattttgtttttttattagggtttgttttttcggaggtagtggggatggtatttgggaagttgttatttttatagtttttataatcgtattttaaatgagagttagtcgtttttggttattagggttagagtagggagggatttatatggtaggtatatttattagttttttttttaggttagatttatagcgtatttttgtggagatttatagtgtttttttagtcgttttttgttttattaggttatagagttcgggttttatgggattttattattgttttttttgtttataggaaaagggatgatagttggtttttagtttttaataatagcgttttaggattaattttagtgttttttttttattcgtttttttttttttaaatgtatttaggtattggggaggggaagaggaagtttaattttttaattttggtcgttttagttgttagttttttgggtaaggtatttttgtgggcgttttttttaagttataggtattttttttttttggtggatatagacgaaattttgggttattaagtttaatttttattagaagttgggtaaggagtcgtgtggattttagagaatttttagttgttataggttttgttttagtttcgttattgttttagaggatatgggttcggcgtggttagagttgtttattttttaagagagtagaaatttggatttttatatgatattttttgatttttaaatgttggtataaagtaaaataagttttttttaaaatattgagtagtttggttgatgtggtgaaattttatttttattaaaaataaaaaattagttgggtatggtgatattcgtttatagttttagttatttaggaggttgaggtaggagaatcgtttgaattcgggaggtagaggttgtagagttgagatcgtgttattgtatttagtttgattgatagagcgagattttgtttttataaattaaaattaaaaataaaataaaatatcgtagggttaaataaaattaaatttataggttgtattcgtttatgggtttagttatgatttttagttgattacgtggtcgtagggtagtaggatattgagttttagagttaggggtgtgttaggtgtgggttttcgatatggtgtttttttgtttttttgtattttgtatgtaaattgttggttgtgttttgattttgtagaagttttagggttttaaggaaaggttgaatgtttatttttattagttagaaagtttagggtttaatgtttagaattgaatgtaatgagatgggtttattaagtttattatatttatattcgtttaaatttgggttgtaaagaatattattatcgttttcgtatagatggggaaagtgaagtacggggtagatatagagttagattgtatatcgggttgatgttagaaagtgtagagtttaatgtttgggttttcgtgcggtttttagggtttttcgcggttttttgatttgttttttgttttttgagtattgtttaaattgtttttatatggtgtgtttttgttttatgggtgttgtagagtaggggtcggtttttaggtgtttttagtattttttcgtgcggttaagttggagaatagaaattagataggagaaggttttgttttaggtttaatttaagaaaataaatgattttttttgggagattcggtgaattttttttttgggagtttttttggagttatttttattatggttaatttatgatcgaagatattgtattaaagtagaggttgttttggtgtgagtttacgattgagtttacggtgcggatgtaatgatttattttagttaggtttacgtgtataagcggattattttagaatcggagttggttttttttttagggtattttttttttttttagttgtttgcgtggttggcgttttattattttggttatttgcgtaaaatgtatatgtgtgtcggtttttaattattttttttttttttttaatgtttggtgtttttttatggatgggtttttttttttttattagttggtttttgtgtttattgtttggttttatgatttttttgggtgtttcggtttagtattatttttatgtttattagtttttagtaagttttgagatagtaggggttgttttattcgtaggggttattttattattaggacggcgttgtttaaaggcgagtttgttttagataatagttaggagattttatagtttttagaattgtaagagaatataattgtgtgttagaagaatagtgagaataggaggcgttttatttcggaggtgtttattttttttaggagatgttttattttgggggtgtttattttttttaaggaaattatgtttcggttggaatgttaagaaggtgatatttaaatgaagaggtgtttattttggtttacgttatttttttaaacgagtatgttatcgtttttttttttttttgggaattttttttaaagttaagtttattttagtttttttttcggggagttggttttttatatagtttatattattttttttttatgttattttggttacgttatgattgttgagattggttacgaggggtgtgtttcggtttttcgggaatagagttgaatgttttttattttatgatattatgtttttattaggttttaggcgtttttagaaaatttattaagttaggcgtggtggtttacgtttgtaattttaatattttgggaagttaaggtggatagatcgtttgagtttaggagtttaagataaatttgggtaatatggtaaagtttcgattttattaaataatataaaaattggttaggggtggtggtatatgtttgtaattttagttattcgagaggttgaggtgagaggattatttgaggttaggagattaaggttgtagtgagttatgattatattattatattttagtttggatgatagagtgagattttgttttaaaaaaaaaaaataattaaaatttattaaatgttaggcgtggtggtttatgtttgtaattttagtattttgggaggttaaggtaggtttaaggtaggcggattatttgaggttaggagttcgaaattagtttggttaatatggtaaaattttgtttttattaaaaatataaaaaattagttaggtatgggggtgggcgtttgtaattttagttatttggaaggttgaggtagaagaattatttaaattcgggaggtagaggttgtagtgagtttagatcgtgttatagtattttagtttgggcgataaagtaagattttattttaaaaaaaaggttggattataggattataggataggtataagttttgagggagtttttaaggaggagggacgtattagatttttatttttattttagtttgtgaagatttattttcgtttgaggttttgtagagggttgattagtgatttttaaaaagatatgtttaatatttaattttaagaatttacgaatgtgattttatttggaaaaagggtttttgtagatgtgattagggatttcgggatgagattattttggatttgggatgggttttaaatttagtgttcggtgtttttataggagaaaggtagaaggggatttgggatataaagagatacggtggggagggttacgtgatgagagtagagattgtagatgttgttagagttaaggagcgtttgggttaacgtaagttggaggaggtaaggaagggtttttttttcgagttgtcggagggagtgtggttttgttaatattttgatgttaaatttgtggtttttagaattatgagcgaattaatttttgttgggttatttggtttttagtaatttgttttagtagttttaggatatttataacgagatttttgggaagatgaaatttttggttgtatagtggtttagggtgaggttagttggtgtggttatttattttttagtttagttttaattttattataattatattcgataaatggtttattgtgggttaacggatacgtggttattttagagttgttatattaggagtttagaggagcgagagttgtttttttttttttttttggagtcgtataaaaattttagatggttggagaagttatcggaggaattatattattttagatttttgttttattgttgggatatgtggtaatgaaataagattatttttgttagggatgttttatgggtaattgtttttttacggaggatattgtgagttgtatttagtcgggaaatattaggagatgtttgttattaggttggtagaatagggttttttagtatttttttttttattagagttttaagattgcgttttgggttttgtagttatatacggtcgtttttttttttttaatgtgtaggttttttgggaagttttttgttattatttttatagtggaatcggtataatttgtttaggggtagtaggtttttgttattttatacgtttttattttttttgtggagggagacgtagttaaggggtatttatatttatttatagaagcgagagtgttcgtgagtttgttattttgtagattttagaatttcgtacgtgattgtatagatttataggtttaattgggtagatttaaaggatttacgtagtagggaggagtatcggatagtttttttttttgtttgtaaggagttaatgtaattgaaggatatagaagaggtttttagttgagtattataattgtggatcgtgtatagtgttagaaagatgcggagttaggttatgttgggaggatttttatgttgttattggaaggtaaagtagtgttatttttttatttatagagtaggaggtttttatttttgttagttattttttttatttgtgaatttaagttttttaaagttagattttaatttcgtaagtttttaaaagtttttttgggttttttttttaatttttatcgattttaatttgttttaaaagtttgaagatcgtttatgtgttttggtttatttttgggaatttattttaaggaaataattagaagtatagaaagatttacgtacgaggatatttgtattagtattaaattgataaaatttggaaatagttcgggttttcgtagattttttaaatttatatgttaaaggtttgtattattattaaaattatatttttgaagatgagaaatgtcgagaatattaagtaaaaatagtaggatataagatgtatataaagattttaattttattttatatatatatgtgtagtttgtacgtatatatatatttatattcgggtagaaaataacgatttttggatggaatgaatggcggtgggtgttgtttattatatttttttgttttttgagatgtttatattatatggggattatttagtatgtttagggaataaaattatcgatattgtttttttttttttttttttttgagatagtttcgttttgtcgtttagattggagtgtagtggcgtaatttcggtttatcgtaagttttattttttaggtttacgttatttttttgttttagtttttcgagtagttgggattataggtgttcggttattacgtttggttaatttttttgtatttttagtagagatacgattttatcgtgttagttaggatggttttaatttgttgattttatgattcgtttgtttcggttttttaaagtgttgcgattataggcgtgagttattgtattcggttaatattgtttttaaaaaatatattttggtattggttgggtatggtggtttatatttataattttagtattttgggaatttgaggttagaggatcgtttgagttaggagttcgagattagtttgggtaaatggtaagattttatgttggaaaaataaaattaaaaaaaaaaaaatatatatatatatagattttgatgttaataagttggagggtgtgggtaattgtatgttggtttatttttatttttatttttggaaaaatattttatagtttaggatgggtatagggttttttttatttttaagtatttacggttttagttgttatataaaaagaggttatagtgggttattttttagatgtaaatttttttttttaggtttatggcggggtcgaaataggagtagtttggatttgggtttatttagagaggaatgtgtcgtataagggattattgttaaggtttttgttttgattataggttgtttggtaaatcgtttttagtttttgaaattagattaagtattttttggtgtatatattaggttttagtttggggagggaatattaagcgagttatagagttttgttttagtttgggataaatgttatgtaaagaaatggtagagtttaaggttagaataattttatgcgtagtttagttttcgtaggagggagtaacgtggtttttgtttagggtagggtggaattttaggtttaggttttaggaacgttagttttggttaaattgggttttttttgagtagtagtaaagtaggttttgtttttgaagaaatattggttatttaggagttagggttagggtttagggaagtcggatagatggtgttaaggagtagggaagtatttttttgtatgttattttgagtttgtaggaaaaagttacgggaaaattttatttggtagataattttttataatttttaggatttatagagtgagtttagtagtatgtacgttatgggtatttttttgtttttatttttttgtgatattggattttggtataggtttttgatttgtgtagggtggggtgggtagttaggtagggttttggcgttggtagagtggggtttagttgtaaaggtttttttattttttatttatttaggatttgggggacgaggtttaaaggtttggtgtgtttttaaggagtttaaggattgttttagggttggagataggacgtatgggtttgtatagggatcgtgttttttattttagggttgagagtaggagaattaaataggagagtgatataattatagtttattttgagttttagtgtttttagtgttatttgttgtaggaggtgatggggtaataaggtgtttttgaggttaggcgcggtggtttatgtttgtaattttaatattttgggaggttgaggtgggtggattatttgaggttaggagttcgagattagtttgattaaaatggagaaattttatttttattaaaaatataaaaatagttaggcgtggtggtgtatgtttgtaattttagttattcgggaggttgaggtagaatagtttgaatttaggaggcggaggttgtggtgagtcgagattgtgttattgtattttattttgggtaataagagcgtaattttattttaaataaaaataaataaataaataaaaaataagattttttgggtgtaggtatggtacgcggtaggggtgattgttgttggtgtaattattattttttgggtgtgtgtttgtgggggttgtgtatgttgaaatgtgtggttattttgttggtgattaaggttgttttggttttattgttattaattacgtttattgattttatatggtttattttcgtgtttttatttagagttttttttagtgtttaagttttcggaaggttggaaggagtgagtagtgtagtttttggttaagaattgaagtataaaaattttagtttttttatttaattttaggtgggataaggttgggggtacggtttgtagtttttttatgttgttcggtatgggggttgggtagttatttgtggttataatgagttggtgaggtattttttattggttggattttttgtttggtttatttttatatttaggtattttttggtgtttttttttattgaaatttttgttttaggatttgtttttggagggatataaattagttttttagaattggtttgggttgtttggtggaggagggaggtggtttttggggtaggtggagtaggtttcggatagggaggaggatatagttggggtgatggggaggggtgtgtttttaggaagtaaaatcgtttaaaaggaaaggtttaaaaataggcgtagtgaagttgagcggagtttgtaaagggaagttaggaaatagtagtgttagtggagggcggtttttaggttttttatagagagttatatttgtttagggatagggataacgtgaatagaaggtaaagtttatattaaggcggaggaggcgttttttttttagagagtcgtagttagatagtttaaatttgttaaaggtttgggagggaagaattagggtattattttatttttagtttaattttttttttagttttttttttttttgtttttttaaggttaggtttggttgggttatagtgttagtagttaagattcgtttttagtgtcggtttagttcgtaggaggttagtttggtggttaaaggttattgattgtttaggtttatttgtatacgtggtttaatgattgaggtttgggatttggggttattatttatagtatttttggataaggaggaaaagaattatttttattaatttttggatggaggtgtagggagcgttaatagtatttttgaaaattttaaatgtattaggggggttagtatttagggaagagttataggaggttattttgatggattttgatgattatttttgtttaagtgttaggaggaggtttttttttttttgtttttggtaattttgggtttaagaagttttaggtatttcggaggttttttttgtttattatagttttatttaagaggtttggtttattttgtaatgatgatgtgagaatgagtaggtttgtttagtgttagagtttgtggttggattttcggttgaggttaagagaaataaataagttttttttttttttttgtacgttataggaagagtagttcgttggttgtaaggggattttttattttgtttatggggtatagtagtttatagtattttttttagaaacggagtattggtaggtttgggtttttgtaagatggaatataaaggggtgggtagttgattttaatagttagtttttgggattttaaatttttttttattttttaattttgtgatgttaatttttttttggataaagttttttaataatttggtaagttagtattagttgaattagttttagtttgaattagtagttttttttagtttagttatagttttatttttttagaagggaaaagaagttttacggatttttttataaggaatttttagaatttgttatggtgttcgtaggggatattggtattaattttgggtttattaaatgtagtgggtttaatagtgttttttaaaacgatatgttttaagttttaatttttggaatttgcgaatatgattatatttggaaaacggatttttgtagatgtaattaaggtaagggttttaaggtgagattattttgaatttagtgggttttaaatttaatggtgagtatttttataaaagatagaaaaggagaaagatatatagatagggggagaaagttacgtggagataggggttagagattagagatgatggtgatgcgtttgtaggttaaggaacgttaggaatttttaggagtcgtcggaagttatgtttgtaagtttttaggttgtggtattttgttatagtaattttaggatatagattttaggaatagaatatagaaaagaaacgggaggaggtttagagtttgttgtggttattttagttattttattcgatttttttagtgtttcgttaattttgaagttttttttagttattgagttatcggttttgaaaaggagatatgggtgttttggagttggtttagtttggtaggaggtagtttcgttttattgtttttttattagttattagtttatataggttttttatagtgggtaagtgcgttgttgttttagttttcgtcggttttttttttgttcggttttattagtcgtagagttttttgttgttgttttttttggtttaagaggtttatatatttagtttttttgggataaatttagtttatatttgttgttttatcgtagttatttaagggttttttttattaacgtgttttttaagggatagtaagttatacggtcgttttatttggggttagaattgtgttttattagagtaaggttttggagtaattatatttagggttagggagttatttgtttaagaatagaaacgtgtggtcgggcgcggcggtttacgtttgtaattttagtattttgggaggtagaggcgggtagattacgaggttaggagatcgagattattttggttaatatagtgaaatttcgtttttattaaaaatataaaaaattagtcgggcgtggtggcgggcgtttgtagttttagttattcgggaggttgaggtaggagaatggcgtgaattcgggaggcggagtttgtagcgagtcgagatcgcgttattgtattttagtttgggcgatagagcgagatttcgttttaaaaaaaaaaaaaaaaagcgaaatgtgtagttttttttttttttatttttgaaatatgaaggggaggtgattgtaggttttttgggaaagatttttttattttttttttttttttttttttttaagacggagttttgttttgtcgtttaggttgcggtgtagtggtgttatttttgtttattgtaagtttcgtttttcgggtttatgttatttttttgttttcgtttttcgagtagttgggattacgggcgtttgtttgggatagttacgtagtagtttttgttttaagttatttttttttacgtagagtagaattaggattatagtaaaggttttagaggaggttatcgtttatagggttttgggttttttttttgaaaggtagtttagtttttaagagggtaatagcgattgattcgggacgaaggtttttttgtgtttgttttcgttatttatcgcgtgtttttggtttcggtagttatagggttattttaggcggattttaaagtggcgttaagttgttggatttttttttttttttattaaattagttatgggaatgggagtatttttggtatatttttagatgtgttgtattggtttagcgttttttttattttcgggttttaaattagttgttggttgttttattaggagtagattgaggggaaatgggcggaagtcgtaggggaagagatgtgaggtagataaagaggaagaattttttggttggggtggggtcgttagggtttgggtgggagggtcgtttatttttcgtttttggtggaaggtagtagaagggtgggacggatttgtgtgggagggtttaggtgtggtttgtttgggggtaggagagggattagatgattttttaggtttttttgggttaaagattttttgataaatggttgtcgttgaaggtaggagcgaggttttgggaggtgattgatttcgaaaaattataggttgtagttttgagggttttaaaggttaagtacggagttttttaaaatgaggttttttttagttttaatttatttacgttttttaggtggttttagatatttcgttagggtttttttggtagtttttcgttttcgattttggagatagagaaacgtgatgttggtttttggtttgtttatagttttttcgtttttattatagggtcgttagttatttttttagtttatcgcgtgttttttttttttttttattttcgattttttaataatagtagatttttttttaaatatttttttgtttagatttcgggttttacgtatgttgtttttagaaatgtattttagttttttgcgaggagttagtaaggttgttcggtgtttttttttatggatgggaagttttgtcggggattaggattcggatttggagattttgaggagcgtgttggttagtgtttgttttgaggttcgggatagagttgttaggtataggtagtatcggtgtgagggtttagtttttcggataagtttttttttgtttgtttttagatttgttattgtatatataggcggtgattatttttgatttgtttgggtagagaagttattttttttttttttttcgttttattgtttattaggggaaatgttataagtatttaaaaaatgtaaaaaaaaaaaaaaaaaaaaaaaagcgtttaatattaggggttatttggtttaggtggagtttttattaattacggggttttttgtgttgtggttttaaggcgggtagtcgatggtttttgttcgagttaatatgagttgtagtttaattataggggacggtgattttagggagtagagtttaggtttcggttatagttgtatttaggagttagttgttttttagatttgtagagttaggggagaggtttggaggatcggtattgaatgatatgatttaaagcgcgttaagttgggttggaggtgacggtagagttatagtggttatagagtttttacgtgaatttatacggatttgtttggtttaggttttgttgaattttagggtgaggaggatttggtttttatttttaaagatatgaagaggttgataaagaagagttataggtaaaagggggtggtgggtgtgttgtgtaggaggggtcgtaattggacgtagaagattttagaaggggtaattagagagaggtagtatttttagaagacgggttgtttggttgttttaaatagtttagggtgtgattgaggggattttcggatttagtcggggttttttttgttttgagataacgtattgggaaattttattaagtttatttaagaatttgaaaagttttttggaaatttagcgggtagggcgggtttttgggaggatttttggtatatcgcgagagttagatatagcgagggggttttatatttttgtttagaagttttacggtagaggggtagaagtttagggaggagtaggcgttgagattagaggggtttataagagaggggtttggggtagggggtagttgttgagaagtttaggaaacggcgtttgtttttggggaagtgaagttttgggaatagggttggtgaaggggggcgggaagggggaggtgggggtggagggttaggttagattaggtattttttttagtagtagatttatgagtttttggaatttgtttatagaagtgataagtgttttgtttttagtttcgtttatatatttatttattaagtgtggtagggatagtcgttttttattatttattttgggatttggatttaagtggaggtttttggaggggtagatttaggggaaagggtttttttagaagtagtcgttatttagaggatttgagatgagaattttattacgtttttattagatagaggagattcgcggtgttttcgagtttggttttttattttttatttagtagcgtttttttcgtttattttaagtttagaatattttgttttttttaagattagttgtcgtagtggattgaatagtgatttttaaaagatatgttagagttttagttttcggatttgtgaatgtgataggagttggaatagggtttttgtagatgtaataaaggattttaagaggagagtattttggatttagggtgggttttaaatgtaatgataagtatttttacgagatatagagatatagagaaaaggttatgtgaagacggagtagggagtggcgtgacgtatttatatgtttaggagtattcgggagttattagaagttgggagagaggtttgggtcggagtttttcgtagaggttttaaaggattagtttggtcgatattttgattttggatttttggtttttagaattatttttagtttttaaagttcgtggggttttgttgtagtagttttagtaaattgttacgggggttttttttttttgttaagtttggtatttaaagttttttagttatttggggttaattatattgattttgggatttttaggttattcgtgtgttttatttttttgtttaatttttagtgtttgtgtggttatagtttttttttcgtgatatgagttttttgggtttttgagtgtttatttgttttgtattgaaggttgaagttaaattttggagagaattgattttttttgtgggtagggtaggtattgtgtttttagtatagttagagggtattggttgaaatgtgtttttgtaaagtgttttttttatgttcgtattttttttttaagtggggaagttagagaggttttttcgattttttttttagttttttggggtaggaagtttgtggttatttgttcgtaaggattaggtggatagataattagttttttttaggttatattttattaatagagggttttttaattttgttggtggtttatgagagaaggaaaaattgaaggagttgtttatagtaaattttaaatttttgtgttagagaggtttatggttgagtaaggtatttttatttttattgttttgagttgttaatttagtttagtttagtattgtgatttttgatttgtttgtgggttacgggagtttggtttgttaattagtattttttagatatttattttgtgaagtttttagtggttgagtgttttttcgtttttttcggatagcgtgggttataggggatattgggtaggaagatagttaagtttttattgtttagaaattgtttgggtttattgtagtaatagggatttatttattagtatgaggtttttttgtaggaggggtgggggtaggagggagtttgtggggtatagggttgtaggaggagttatttttttttttattaaatcgtaggttttagttaagttatttttagtatggttgtttgcgtgggaagtttatagttgagggattgtttgtacgtggtatgtaggagttataagcgttatttatattttatttcgggttaggtagatgatttttttggttttagttttttgatgaggaataggaagggttggatcgaaagattttttttagttcggatatggaatgattttacgagggttacggtgaggtttgttttagtttcgtatattagttcgggttagtagtttttaaaggtatagtcgtaggggttttggagtagggataaggaggattagtttattttatttttttgggtagaggttaaggattttgtttttggtttatattttttgtggttaaaaatgtagaagtaagtagtgttggtagaggtatttagatttttgggtaaagtaggggttttatttgatattttaggtttggagtacgagaaaattagtttaggttttaggttttttgattgttagcgattagggaatgtgatatttttcggtttttgtttttttattttttaattttagggggagattaggttgggtgatgtgtttttttttttgatagtaaatttttatttatttttatttttatttttgttttaagagggggttttttatggtcgggcgtagtggtttacgtttgtaattttggaattttgggaggtcgagatggatggattatttgaggataggagtttgagattagtttggttaatatggtgaaattttgtttttattaaaaaatatgtgagttggtaattttaagtttttagtagttttcgaatggaggttttttttttgtaggatttttaaattttataaatatgagtgtttgtaatttagttatttaggaggttgaggtatgagaattatttgaatttgggaggtagaggttgtagtgaattaagaacgtgttatcgttattttagtttgggatatagtgaaattttgttaaaaaaaaaaaaaaaaaaaggtgggggtttttttatgttgtttaggttggttttaaatttttgggtttaaggaatttttttgttttagttttttagagtgttgggattacgggtacgagtttatgaattttaaaaaataatatttattgttttgtttttgattgtaaaaggaatttaggtataaagtcgaaaatttgtaaaatgtataaaaataaagggaaaaaatttataaatttataatttaggtaatttttattaatattttgataaatgtttttttattttttattggggagtgtgtgtgtgtgtgtgtgtgtgtgtgtgtgtgtgtgtgtgtgtgtttaaataggtttatatagtgatgatgttgggtgtttttttttatgtggcgttatgtggttgaggtttttatatattttgggttcgttttttcgatttttttgtagttttgatgttttgattttagatatgttatttttggttcggattgtttaggagaattatttttggattttgttaaaaaatggattgttggtttttaatttttggtggttttggtttaggagggttgggtaagtttgggtatttcggagtgtttttggggcgttgtaggtgtgaatttttgtttttttgaagatttataagttttattttttttattttttttttttttttcgagaattttataagaggaaagtttttattcggaggttgttagggattcggagttgttagtttatagttttattttgtttttattttttcgggagttatttaaggataatgtttagttttagttgttaagttttagttttagggttagttatatattgaaggatatgtagaagtcgtcgtgtgttgggtattgttgaggataaaggtttgaatgataagcgggaataaagttataaggttttaaaatttgttcgaggttttatagttagggtttcggaaatttatgaaaaaagttagtttaatattttgttacggaatataggtaggagagggagtagtttttagttagtttttagttagtttttcgttagtttttttgcgaattattttatttcgggttatagttagggtagtcgtcgtttttttttttgttcgatagtttttgagggtaggagttagtttgtttattattgttttttttttattagggtttggtattttgtttggtatgtagtagaagtttaagaagggtttattgtgtttattttgtaatagttaatgtgtatgagtgtttattatatttgaagatagtgatttatttttgtttttattgtatagatgggaaattgaggtattgagaggttgatgatttttttatattgtcgtgtgggtaagggtaaggttagatgtgagtcggtacgttgggttatcgcgttttttgtttatatttcgttttgggtttgggaaggttattttcggagatttttacgatgttgatatttcgtttagttttttcgtgtatttttttttacgttttttagttatttaaagtattagttaggtagtattgttattttggttttgtaaatttagttattgagtggaagagtagttaggttgaagtggggtagaggtagttttcgttagattttagggtcgggatttttagttatttttattttttaaggattagtagatagagatttttatcgtgtttagttaggggttagggaataggtttttatagtgggggagtgatggatggatgtaggtgcggattgggaggattcgggtcggttttttagcgttggagttttagtagtttaatttattttgttgggttttcgtggggattaaaagatattttgtatataaagtattagtttagggtttggtatttaggaggtgtttaattaaaggaaatggttatgaaaaataataaggagaagtttagttataggaggtgtttgtgggtaaggagagaatagttggaagggtttggatttgggttagagataaagaatgtaagagggagggagggagagaaggagggagggagagaaagagggagggaaagaaagagggagggagagagggagggtagggtaggtaatagttggttttagggtagttgtgtgtaggagtttgttttattatttaaatattaggagagatgtaaatatttgagtgaggtttttttagtttggttttgttgtggttatagttagggttggagaaagagttttttttttattagggttttcgttttgtgttttttattttagttgttttaagattttatgttttcgggttaggagtaggggtttgagagtagtaattaggtagggtagcggggttagggagggatttcgtttttgtttttatttttttttttcgtttttgtttttatttttttttttttgtatagtattgggtttgtaaaggtgcgaatgaaggatttttttttttattcgattttaaggggtttaggcggttaagggttttttttgtagtttagaaaaaaaagtaaagtagttttttttgaggttttttggtggaggtttagggtttaaagttcgttgttataaatttgtagttttttttgtttttttaatagtgttttttttttatttgggttattttattattttggttttttttagttttttaggttttttggggaggaggatagatgtagagtttggatttcgtgcgtagtagggtttttttaatgttgcggtgtatttcgtttggttgcgggagtttgttttatgttatgatttgtgttggtattaatagtttttttttttattttttatttgagtgtcgagggtagttgtgttaggtatagatatatagttttttatatatattatgagtttgtagaaatggtaagagaaggtcgagcgtagtggtttatatttgtaattttagtattttgggaagttaaggtgggcggattatttgaggtaaggagtttgagattagtttggttaataggatgaaattttgtttttattaaaaatataaaaaattagttgggcgtggtggtgcgtgtttggagttttagttatttaggaggttgaggtaggagaatcgtttgaatttaggaggcggaggatgtagtgagtcgagattacgttattgtattgtagtttgggtaataagagcgaaattttgttttaaaaaaaaagaaagaaagaaaaagaaaaaaagaaaaggaaaatggtaagagaagttggttagtattatttgtttggtaaatttttatttcggtttttggttaggaagtttttttttaggaagttttttcgttttatttttttttttgagtttatgtttagatttttagtgtttagaatagagttggtttttggggtatttatggatggttgttggataaataaataagttaattgttttttttatttttagcgatgtttttggtttggtagggtatttagtagtaatgtttttcgagtggattttaaggagtattttttatcgtgtagtttgtattagggattttagttttttattttaaattaaaggaaaaaatttaattttagtaaatatatagagtattttattttttgatttttaatggggggtaagaggtagaggatagaggagaagattatttttttaggtttggtttggagttaaaaagatttgtatgtttttattgtagataatatcggtttttgggggatatagggtaggggtttggtttgtttttcgtagggaaattgtttatttacgtggaaagcggggttaagggtttttgtttggaattagttttttgtatatggggtggggggtggggatagaaggagattttgtttggattgtatggaaatttattagattgttggttgttgatttggtaggagtagagttatttttattttttagggttttgtttgggggaggggagaggttaggtggttttgtttaggttatattttttatggttaggaatgttttttttttattagaaagaaagatgagataggtttattttgaattttttggatataggaagggggtttatttgtggtttaggtggtttttttttttatatttaaggggttttataaggaggtgttaggatttttaggttttgttttagggaattgttgtttgtaaaggttataggtagagatagttaggaatgttttttatgttattggttatgggttggaggttgcgaaattaggtatagaattagaaagatttgttataggttgtaaagggttttagagagttttagttttttagaggggtagtattgtagaaggggtgagaaggaaaaattagtttttaggaattgtttatttagagtttatataatatttaggtggtacgagataacggtttattttttattttattttttcgttgttttttaagatttgagtttttgggggtgtttttagtagatagggggatgtggggtaattgtttttttttaattgtatatttggaggtaatttatatttagatgattttttcgaggttgtgattagagtttggggtaggggaggggaagcgggtggatgggaaggcgagggagatttttttaggaaagtcgttttaggtgtttgtaaggttttatcgtttatatttaaggtataggtttttggttttgaggatataggaaattcgatgttatgtggggaggagggtattgtaatgtatttaaggttaggttttttgattttttggatattggataaatgatggtttttttagttggtttagagatgttaggagtgatagaatgttaaaggttgtagggggatatttagaaattttcgagaaagaagatggataaggaaaaataaaaaaatacgagaagtttagtagagtttgagtttcgtattttcggttttttttatggttacgggtaattttttggagatttagttacgggagtagtggaggtaggtatgggtgggggggggggcgggttttattgtttatggtttcggttgatatcgaggttatttttttgtttttttaagtttttgggtattggtaggatttttaaaaacgataataaatttgaagtttttagaattgtttgttggtttagtttaaacggagtttcggggttttgtagattaaattaaatagtttgagtttagaaatgttttaggcgtttgggggtgtttaggggttaattggtgggtttgtttggttggagagatgataaatttttttatttttgggattgtgttttagagagtttcggattttttggttttataagtaatttagagtttttaaatttgggaaaaattaagagggttttggaaagaaaggtagtgtttgattatttttttttagtggttttgttaagggagagtataggaatttggtttttggttgggtttttgggatgaattaaaataaaaagaaaaagtcgggggagggggtggcggaatcgttcggggttttagtttaggttatatattaaggagattttagaggagtaggttagttttattttcggtacgatgatggacgggtatttggttggttggtaaagggaagagatggtaatagtgaggttttgaatttagtggttaagatttatttttgagtgtgattttttttgatgtttgggtatgtaagaaatgggaggtggagaaaggaggaggagattttagttttgttttttcggtattaggttattagggaatagtattttttttttaacgggtaggtagaggttataggttgttaggttgagaagtttttggtttttatagataaatgtatagtttgtatatttgtattattttgggtgatgtttattacgtacggttattatgtacgttttttattattaagatagtcgacgagattaggtggttattgtgtatcgggtatcgtggtgattgtttgatattgatttttgggggtttaggttttcggtgggtttgtttttttaggtatttagttttttttttattttttgatatttcgggtttagtgtaggggtatgggggtgtttagtggatgggtttacgggttgggtaagtagtacgtagttttggtttattagtttttggttttattattagataagatgagattgttttagttgttagtttagttttgtattatatttgattgggtttttgtagaggtttgttggatgagaatgtttagggtagtaggtattattttttgggatgtatattttgttataatcgttttttagggaaaggttagtttgtagagtcgaacgtaggttgttagcgttttcgttgtttttatggttcggttatttagtaagtgtttattttattgttagcgtttggttttgtagatgggtatatggtttatttatttgtgatattttagggtgggggtgggggtagatggtggtagggaagattaggataattttttagtaagaggaatttgtagttaatatgacgttagtttttagaatgttagttaggtaggaaaaggggggttttatggttgtattgggagtttgagtatttgtcgggtttagagggatttttaggcgggcgttattggtattagtgtttgtcgtgttttttataattagtggtgattatgttgttcggttttatttatatagtggtattatataggtttttgtttgagattttttatttttagatttgtatatttaagtatttaaatttatttgttttttgtaaatgtttttttttttcgtttagatgttatattagtcgcgatatttattatattcgtaggaggtaggattcgtgtttagcgttatgggttgtattttagagttttttagtaatttttaaagagagttgtttttaattttattttgtaggtagggaaataggcgaagaaattgaagaaatcgaagtcgtttagttttttaatggtagagtgagggcggtttgggtatttttatattgttatattttttatttttttaaagtattgtttttttggatgtaaattttgtttattagttttatttaaaatttttttggatagttatagtttatagaaagtatttttagtttgtagttatttagttattgtaggggtgttttggcgtttatttttatttgttttttttcggatatttagtttagagaatttatagtttcgttgtaaggttgattatagtgtatttgttgtttgggtgttgtgttcgtttttttttaaatgaattaattcgtagtcgggatagtgggtttgtttggttttgggttttgaatttaaagagtattaagttagtgttgttagtggttgtgggattcgtgtaagaggtttgtttttattttttatggtttttgttttttattataaaagtttaaattgtagagaggtagtatttataggatgttttgagttttggttgaaaggtagggtttattacgtaagaggtttattggtattaattagggataggtttgtatttattattaagtaacggggtttttttttttagagaggaaagaggtatttgaattttgttagcgcgttagtttttacgtttcggaggtgttgggatttttagataagaaggtatatttatatggttttttttatttagaagttcgttttatagtttgttttgtttttagaatatagatttgggggtttttttcgggcgatagtgggggttcgggagaagtttagatgttatatagttttgggatttgagtacgtgggttttgggttagattgttttaataaatattaaggatttttggattttttttcggtgtgtaaatttggttatagtaaatatcgttgagtaaagtaggttaatagttggtatttggaaaggtttttgttatataaagattcgagttgtaatcgtgtttgcgataatagatttggtttgaatttacgaaagtatatgtcgttcgttagtttcgtgtttttattaattagaagggagaaagaggaaagggttattttttttgttattttattacgggtagtggcgggtgttgtagtcgtttggaggttcgtttgtatagtggaaaagtagaaaatgagattttaaaaattttattagttaaatataaaatattttttttgttgttacgtggcggtttttatagagttttaaaattttgaagttcggagatttattttgaagggggagtaaaggcgggatgcgggaagtttgagtttatggaagatattgatattttttttatttttgggaattttgagtttgaaggattcggtttgaatagcggaaggattgaatttttgtgtaatttatcggtgatggaatataaagttatggtgttttcggtttttaagacgggagggatggggaaggttttgggtgaaggggataggcggggaaggaaaaggtgaagagaaaggtgttttttagggagggggtagatgtgtttaggatatgggatattggtagaattttaatttcgagtatatatataggtttacggacggtttttcgtttatttgttttttacgggtgtgttgtgtcggtttgggtatttgtttttttttttatgttaggttatttgtcgtttattttgtatattgttattagttttaagttttttagaatattttgattagggttttgtggtttttgttataggattttaggtttagacgtttgttcgattggaaaattgtttttagagatgtcgtggtttagagttcgttttgttttggggtggtttttggagttttcgttttttagtaatttatatggtgataggtatttatattcgttggttttaggaattttggggttattattttagcgttgtaaggagttggtagttttttttttattttttcggtttattttgtaggaattaagatattaggtgagtcgtttcgggaaagagatttgtgtttttacggcgttgtttttgcgtttatttttagttattttagatgtttttcgtggattagttgtattttcggcgggtatgtttggtttttcgtagtttggtttatatgatttttataggtaggtttttttttatgttttagttttttttttagttagtttattttagttttttttattgttgttggttgttgttggttagaaggttttttttttttttgtaatttaatttttatttttttttaaggttcgttttttttatattgattttttttttgttagttagtggtgatttttttttattttgattcggaagttgtttgtttatattatttttggttgggttgaattatatttttttttttattttttttaattattttttttttacgtttgtttgtttatttaaggttgtttaatttttatatatatatttttatattttttaattatattttaggttttttgggtattagggagggttatttttttatattttaggttagtttttatgtatatgcgtatttatgtatatatatatttttttacgtttatcgattcgggttatttgatggttttaagattagaatttttagtaaaattatttaggatatataagggggagattgataaatatagggaattagtagattgaggttttatttttcgagattgagaaatttttttttagagttaaaggattgttaattgttgtattaggatggttttaatgagtttattgttttggattaaattatagggttataaaattggtttgggagatagtcgtagaagtagttttagatggaggtatatgggggtaagggtggagttatatttagagatttaaggaaggggtattaataatttttatagtgtaaatggtgatagttgtataacgaatataattttaaattttggttttttttttcgttatagggttttcgttgagatacgagagtttttttttagaaattttattgggggttcgatattttttgttaggaattgagagtagagatttcgatttcgtaggtaggaggagagttttgtataatatagggtttttttttataagggtttattggaaagtggttagatcggttaagtcgtgttatttggatatttgggataaggaaggtttttggaggagcggtcgtagggaggagttgtaaagaggtaggggtagggaggttatatttattcggggattgtaggaggtttaacggaatatagtggatttagggagattttagtatgagtatgtgtttaaagatgtttagatgaggaggtgttgtgggggaggggggcgggaatagtaagtttttttagttttgtagatttagattttttttttttttgggaagtagggatgtaaagggatagagtttgaaaaagggtttttattattaagttgataaagtaattacgatgtttttagtttatattttgtatagcgttagtggttattggattataattttttttcgttttttcgtcgttttatattttttttaggtttagttttgaagaatagttattggtattttgtttggcgtttagttaaagttttggttttttaggaggtttcgttttttttatttagatagggttgattttaggtgggtcgtgtgggtagttgggtttaggatatttagatgttagttttggttttggttatggagcggggaggattttaggttggttattttttagtttggtttgatatttggatagtttgtttattttaatatagtttttttttttttcggtttattagagggttttgtttaagttagtttaggagttttttcgaggggcgggggttttaggtttcggtagaggtaggttcgttttttagaagttttgttttagagcgttggagattattgtgtgagtttttttttcgtttgttgtatttattttcgcggacgtaggacgtagagttttagtatcggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggttttttttgttttttacggttcgattttgggaggcggatgaggatatttttaggtttggatgggggttatgggatattttattttagattttgttacgatttgggttgtgttcgttcggtgttttcggtttacgggttgtataatttggcggtttcgaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattatcgtttcgggggttatcgttgtatttttttgggtgagttttggagaaggtattgttcgggagaaggggtatagggcggggatggaatacggttgttagagaagttagggacgggcgacgtttttttttttttataataagggttttttgagagtaggaagtagattttgttaggagtagacgttttcgaaggaaggtgtgaaggaaggagttaggtagtgagtgagtagaaagggagttgttttaagggttttttttttttttttgggttttaatttgaggtttagttttttttttaggttagcggtttttatttttaaattatattatttataaggtaggtagggtcgaggggttggggtagatttggggatttgggttagatatagaatttgagaagtaataggtttttatttttaagaagggttttttaggtttgttatttataagagagagaggcgttttttttattcgttttggaaagttagaaatttatttttgtatgttttttttgttatttcgttttttagattttcggtttttgtttagagttaggggttatgtgagaatttatagtatggaataatatttttattttcgaagtagtaggtcgtaacgttataattgtatttcggttttttgaatgtgtggtcggggagcgtttgatagtttattttgggtttgaggtcgttcgttgtttatttgtttttttttattttttttgaaatattttaaatgtgtaggagtgttgagattttttagttattttggagaggcggggggtagggggttttttgcggaaaatgttttaggtttgggtggttttttaagtagatgaaattaagttttttttttttaagaaaagtaggtatttttttttttatgttttggatattttgaattatttttaattaagtgagtttgtggatatgggaattgtaaaattatagatattttagatgcgtgtatattttcgtcggtttgggagttcgggttttagaaatgtagttattgttgttattaatagtatttcgtattttttacgttaggttagggtatgttttgtttgaattttagtatttgggtttatcggatagtttagtttttattgggttatttgtttacgtcgtatttggggatttgggggtttagtatttaagaaatttagtttaataatatagtttttttgggaagatgtcgggttcggtataatagttattttaagttatagtattattttcgagtgtttttttaaaaagtatttggtgagtgtggatatatttatgtaattgtttttttttagggttggtatggagttttattagattagtatagggttagttaattgtatattttttatttttacgtatagtgtagtaaatatatttagttttttggggagcgtcgttagggtgtacgttttattaaaatgggaatttaagggataatggtaggagagtagttagaaagtgcgtatgttttcgtgattgtgtttagagtttatcggttttagttttagttattgtttttttaatgtaattatttagagttatatgattaggtttagaaatttttaggtaaggaggtttttcgagtttttttaggaaatttaaattagggtttggttatatttttagttaggaagtttattttcgtatttaattaattgttttaattgtatattatttattttttttttttttttgtttttagaggagatgggaaatagttgggtattattttttaagttataattattttttttatatttaaggataatttagttgttttttggtttttttttttttagtttaaattatttttttttagttttttaattatatttcgagttgttttttgattatagttaagggttgggtttagtttggggttttaggattttaatgaggttttattgttataggatagtgaggaggttttttattttttttttttagggttttagggtttggatatatagttttagaaggggtattgggtagagaagatgtacgtcggtagtagagaggaaattgagttgaaatttggtaagaataaaagaattataaaggtttgtgtatttagtaaggtgtatttttttacggttataaaagaaggtaagatcgattgtaggtttggttaaagggatcgtttgcgtttttagtgtataacgagatttatagtgggtcggtgattttttttaaaataaagatatgtttatttggaattttaaatgtgatttgattttgtttaagggtttttgtagaaagaatttaggtaaggattttaagataaggtgggttttaaatttaatgttgtgtttttttaagagatagaaaagaaagtatagagatatagaaaaaggttttgtgaagatagaggtagagatcggagtgatgtagttataggttaaggaatatttggggttattagaagttggaagaggtaaagaaaggtttttttttggagtttttagaggaagttggttttgttggtattttgattttagatttttggtttttagaattgtgagaggatatattttttttgttataagttatttagtttcgatagttgttatagtagttaggagaaattcgtgttttatttttatttgtattatgttttgaggttaaagttttatatagtaaagatgtttaagtaattataaattttgtgggtagtttattcgtttagtagattattgttttaagggaagggggatggggatagggaagagagttataggaaatttttgtacgtttttttggaaatgggaaggagtaggtttggagagaaattttataggttaggtttcggggaaatgaagtttataaagcgtgggaacggagtggggaggaaatttacgaggaagtagcgtttggcgtatatatttatatttatgatttttttttaggtatagtttttatggagaggtttagttggtagggaagtaaaagaggttcggagagcgaaggaaggtgaggggtttttttttagtaatattgaggttttagacgggatattttattaggtggtaggttgtgtttttatagatagagattttttaagggtagggtttagatggttttatttttgcgtggtttgatataaagtaggttttttagagttgtcgagttttgggttcgttagtggtagagttttttatagttttttaagtttttatagttttttattttaggaaacggtgttattatttatttagttgtttaagttaagttttcgggtattattgttgattttttttttttttttatttttagtatttaaattatggtgcgtttttatttttagtttttttgcgaattagtttgaattttttttttttagtagtgtgttagttaacggttaataatcggttatttggggttagtaaaagtaataatatttagtttttcgatttgtagcgtttgtttatttttgtggtgttaatatttttgttttggttaattttttttttttttttttttttttgatagggttttattttgttattcggtttggagtgtagtggggtaattttggtttattgtaaattttattttttaggtttaagtgatttttttgttttagttttttaagtagttcggattataggtattcgttattatttttggttaatttttgtatttttattagagatgaggatttattttgttggttaggttggttttgaatttagatgatttgtttgttttggttttttaaagtgttgggattataggtatgagttatcgtgtttagtcggttaattttaagttatttgtatgatattattggaggtgagattgagaagagatgtttagttattacgaatatagtgtttttattatataaatataattttaagaatataatcgtaataggatagataatagttaaatgttgtaaaaaatttaagaggtgatgaaagttgtgtatttattattttttgttttaaatataattatttataagtaattttttaatgttttgtttaattttttttttataatttgtaatttaatttatattgtaaaaatttattatttttttaatagagtaatgtatttttattgtgataaaatatatgtaatataaaatttattatttttggttagttattatggtttacgtttgtaattttagtattttggaaggttaaggtgggtggattatttgaggttaggagtttaagattagtttggttaatatggtgaaattttgtttttattaaaaatataaaaattagtcgggcgtggtggtaaacgtttataattttagttttttgggaggttgaggtacgagaatcgtttgaatttgggaggcggaggttatagtgagttaagattacgttagtgtattttagtttgggcgatagagcgagatttcgttttaaaaaaaaaaaaaataaaaataaaaaagataaatttattattttaattaagtttttatgttagtgatattaagtatatttatattgtatatttattaatattatttattttcgaaattttttttaattttttaaattgaaattttgtttttattaaataataattttttattttttttttttttagttgttggtaatcgttattttaatttttttatgaatttgattttatataagtgaaattatataatatttgtttttgtgagataggtttacgtagtatgaggtttttaaggtttattatttaaggtttatatgtagtgatagaatttcgttttttttgaaggttgaatgatattttattgtgtgtatatatattttgtatatttattttttttatatttgagtaattgagagtaaagttgttataaatatgggtgtgtaaatatttgtttaagtttttgtttttattattttattattattattttatttattattagtattattattattttagatagttttattttgtcgttcgggttgtagtgtagtggcgtgatttcggtttattgtaattttcgttttttagatcggagtaatttttttgttttagtttttcgagtagttgggattataggtattcgttattatgttcggttaatttttgtttttttagtagagatggggttttatcgtgttggttagggtagtttcgaatttttggttttaagtgatttattttttttagttttttaaagtgttgggattatagacgtgagttattgcgtttagttattattttagttttaaatattatagtaatttttttattgttttatgagattttttgagatagtggttttagggattttatatatatttgttcgattttgtgtaatgataaagcgtagttttttttgtagaatggtagagtcgggagatttttgatggggtatgagtttaaaggggtagaggggacgtttagaatatatatggattttttatgtgcgttttgttagttattaagtagatttgttttagtttcgatatgtttaggattatagatagtgtatggtttttatttgggttaagttttcggaattttttttttttttatattatttgtattgggagtagttattaggttgtggattattaagttttttttaggttatttgagtttgtatttttttatttagtttgattgagtcggtgtgtagttattatattttattatattttttgtttggtcgttttaatgtaattataaggttttatttaaagaagtatatgattaatttgttttttagattttttagtgatttttttagtttgttttgtgtagaatatttatagtaaaatttgattatagcggtttgagtttttatttttaaggtaggggattttttaaataaagtattagtgttttaaatttatgattttttaaggaggtttttggtttttagtatagtaaatgttttgttttatggtttttcggttttttatttttattttattcgagtttttcgtttcggtatttgggattgaattagtttggagttttttagttttgttgtttgttggttttgatgatattattagggattgtagtattgtttggattttttgttgttatattttattgtaataatatttaatttgatggaattttgggagtaagtggtaggggtagggatggtggtggttaggggttgtatatatataggatagaaggattgaaggattgggtggaaagtatgatttttttaagatgatttttttttagtagaattttggttgtgttttttgaatagtatttgtttatttgtatatttggtgagttttgtgattagtaaatttagatgtttgggaggttattagcggttttgttgaggtataatttagatatgatagtttatgttttttttttgatttttttttttttatatagttttatgattagagcgttttttttatttttgtttttattttagtttcgtaagatatagtcgtgaaatggttaaagtttttaattttttagtattcgtttgagattggagtataaaaatgagatggggatatagtattttatggatattagtgatggaaaaaaattttttgattttttcgggagttttgtaaagttatattaggggataagaaggagtggttagtttggtatcgatttagttttaaagtagttagtgattaaagtatatagttggtatttttttatttttagggtattaggaggtttggttagaatttatgttagttaggagaaataggttgtttttggggtttttggtgttttggtttttttattgtttttttgaagaaggtattttgttttgtggggtttgaggttggaggtaatttgttatcgatgtagtgtagggatgagggttgagttattagtttgttttagttttacgttagtaggaataatagggatttaagtagagaagaaagtatttatttttaaagttattatagtgattgaggcgacgtggtttttagggagtttttttttttgttggttttttgtggatcgcggttttatgttttaataatgtttttgtttatttcgtaaggtttagtaggtggaaggaaagagggtggaggttgggagtggcggtttggtaattcgggaagggtagggagtaggaatatgtttttttttttttgtattcgtttagaaggttttatagggtttgttttgttatttataattttagggagatttttttttaatgtttgttttataaatgtttatttattttatatttgaatatttttagttatagggagtttagtatttatttatgttatttattttatttttggttgtttaaaaaagaggaaagagagagaaagaaaagataggaaagatagagaaagggggaaagagagagagaggaaagaaagaaagaggaaagaataagataggaaggaaagaaaaaggaagggaacggaagggaaggaagagagggaagaaagagagaaagagagagaaagaggtataaataaggtaggttttatggagtagagatttaataagggagtaaaatatatttgtagttaggttgtagatggatttttataggagcgtatatttattttatttttttcggaatagaaaagtggaaagaagatgtagcggtgtgggtgggtggcggttttttttgggggtttggaatgtggggtattagtttttttggttttgagaaggagattaagattattaatatttatagtggagatcgaattatataagggttggggatatcgttttttttgtatttttaataaagattcgatgttttaattatgggaatttgtggaagaagaaataaaattggttttggggttttttagagaattggttttttatttagtggtggttgtgaagaaatttttggagttagttttagcggtttgggtttgtatagttgagattgtttttggaagttgagtggaagtggggagtttttaggtatagttgggttttgttttttattttagttagtagttttaggatttttgggtgttttagagttttttttagagggtaaatttagagtatgagggagcggggagatgtttaatattgggggatttttgttcgtttttgtttttagtttcgttgatttgaatagggaggttatgggtgtttaggggtagaattgtgggttggtaagtttttagttttggtttttttttgtttttttttttttattgttattgattatttttggttatatgttgatatttttataggatgatggagaagagagaagaggaattttttcgttttgtttagtatattttaaagaggttttagtgtaaaggtatcgacgtttatagttaaatgtgtgtgggggttttttaggagtgggacgtttttatttcgttttagattgttatgaatcgatagaaggttttatgttattaaatatattttattaataaattattttaatatttagtaaaaaaataaataaaaatgtatgtatttcgtgttttgtagtgtttttatgtcgtatttttttttgtatttgagtttcggttcgcgtttttggtttgtcgttttgggaatagaacgttttgcgtgggaggtagataggaagcgcggggtgcgttggttgggtttttttagataatttggtattgttttttttagataatgaaattttttttattttgagtgtttttggaagttagtcggtagttagattaatttaaatgaattatttgttttttttgtgaagtgattttagggatttaatgggtttgttattaatatagtttttttcgtattttgttttttttttttatttttttttttttgtatgagttattggttacgatgattcggtttagttaagggatttggttagttttggttaggttatgtgagagatagtataaaggattaaggttgtcggaattaggttagaggttgagggttatacggattttttggagtgtttgtaattggggatttttaaggttgttttttggttttggggatttgtttatttggggatagttttaagggagatttttaaaagtagggagttaaaagggtgaattaatatagaaatattgagggttagggagaatttgaagatgggttcggttgggtatagtggtttatgtttgtaattttagtattttgggaggttaaggtgggcggattatttgaggttaggaattcgagattagtttggttaatatggtgaaatattatttttattaaaaatataaaaattagtcgggtgtggtggtaggtgtttgtaattttagttatttaggaggttgaggtaggaggattgtttgaacgtaggaggtagaggtggtagtgagttaagattatattattgtattttagtttgggtaatagagtgagattttattttaaaaaaaaaaaaaaaaaaaaaaaaaagataggtttaaggtttggagagttagaagttatttttttatttttgggtggtttattttgagattgtattacgttagagaaagttgcgggagtgtttgtttataatttataagtaatattgttttttttttttattagtttttggttttagtaggtttttgattcgtgttttttttagggttttgggtttttttaagttggattttcggttgttggtgggatgattatgtgatttgttatttttttgtttatcgttttgggtagtttttgttatttggtgtatatagagtggagtttagtaaggtcggggtcgtcgattttttgttagttatatttgtttttttttacgttattttttttcgttttggttatgtttaggggtttatatttttttataagttaggtgttagatttttgtgtttgttttattttgttttttttgtttggtgggttttttatattttttttggtttgatttaggtttgatttgtttttaggttttagtttagaggttgttttttttaggaagtttttttgggatcgttagatgaagggatttttttttggattttttttttatttttatagttttaggaatagtttttaatttaggttttattgagttagtgtggtatttaggagagttataagcgtgtgacgaacgtgttgaagtttttttaaaagttgaaggagttttgtgaatatatagtagtattagtttagattgcgaaggtataggggagttagttttttttagtttcgtttgtttttggttttttttttgaggaggtgggagttagttagttgggattaggaggtgggttttatggagtagagatttaataagggaataaaataaattagagaatttttttgttgtaaggaatttagataaggagtatttagttagaggaggaaggaagagatcggtagtagattttttttgttttagtagttttgtaagttagatgggttaattttttagtatagttgttttttagtatagagaaattttttatttttagtaatagggtgggaatatttttagatagggttacggttattttggttatagggattacggagtttgagtttttgtggtttgttttatttatgtggttatagattttgagtatatatttggagttatagagtttaaagggtagggtagggtagggaatttgtttgattggtgaaggttattttattatttggagtataggtttttgtttttaaatttatatggagttttcgatacggggtatcgattttaaggaggtgaatgtggatatttaaggttagtgaatggttaggtgttaatatatcgataggtttttggttttttttttaatattgagggtaggaaataaatggggtttatatggtgtatatggtttttagagttagtaaggtgtgtaagattcggtagttgagaaaattgattatttggtcgggcgcggtggtttacgtttgtaattttagtattttgggaggtcgaggcgggcggattacgaggttaagagatcgagattattttggttaatacggtgaaattttgtttttattaaaaatataaaaaattagtcggacgcggtggtaggcgtttgtagttttagttatttcggaggttgaggcgggagaatggcgtgaatttgggaggcggagtttgtagtgagtcgagatagcgttattgtattttagtttgggcgaaagagcgagattttattttaaaaaaaaaaagaaaagaaaagaaaagaaaattgattattcgattatgaataagttagaatatttatttagaaaaaaaaaatagttttgtttaattggggatttaaaattttaggatttatgttttttttttatagagttatattatttttttaatgtttattttcgattttatttgtttgttaagttttaggtatttagaatatagtatgatagtaagttttgtgatttttataggtttttttaatttattttaggtatagttatatttttagttttgagtagtagggagtgatatgtagatggttatttagatagagaaagatttttaaaaggagggtaggttttgtttcgtaggtagtatttattgatatagatattagtaggtaaattttttaggaagatttttattaagaaagaacgaaagaggtttagtgcggtggtttacgtttgtaattttagtattttgggaggttaaggcgggtggattattttaggtaaggagttcgatattagtttggttaatgtggtgaaattttatttttattaaaaatataaaatttagttggacgtggtggtgggtatttgtaattttagttatttgggaggttgaggtaggagaattatttgattttaggaggtagaggttgtagtgagttaggattatattattgtattttagtttggggggtaatagagagagatttcgttttaaaaaaaaaaaaaaaaaaaaaaaggatgaaagataaataaggttgaaattggtaggttggtatatttttaataatttattttaggtcgggcgtagtggtataatgttagtattttgggaggtcgaggagggtagattgcgaggttaggagatcgagattattttggttaatacggtgaaatttcgtttttattaaaaatataaaaaattagtcgggtgtggtggcgggcgtttgtagttttagttattttggaagtttaggtaggagaatggtgtgaattagggaggcggagtttgtagtgagcggagatcgtattattttacgttagtttgggcgatagagcgagatttcgttttaaaaaaaaaaagaaataaaaaataaaaataataaaaaaaaaataatttattttagtagggagtaggaggtaaggtttgatatgtagtgtttgttaatttttgtggtgtaaatatatttattgtggtaaattttaagttataaataggatattattaaatatagagttgggaaaagatatgtatattattggataaaacgtttaggtagttacggtttatttttttttgggaaggggggtatgtttagaatgttttttattatggagaatgattgtggtaaatagggtttaattggtaggttgatttaattaattgtttattgatgtgatgtggggtaggtttttgaggttgtttttatgtttagggaagaaggtggttatgtggttatagatttggttttgggtttgttttttttttttttttttgagatagagttttgttttttttttttaggttggagtgtaatggtgtgattttggtttattgtaattttcgttttttgggtttaagtaatttttttgttttagttttttaagtagttgggattataggtgtttattattatgtttagttaattttgtatttgtagtatagatggggttgttggttaggttagttttaaatttttgattttaggtgatttatttattttggttttttaaagtgttaggattataggtatgagttattgcgtttattcgggtttgttattttgaggatatatttggagttatgtgtttatgattttttttttattttaaaattttgattttattttattgtttttagagataggttttgttttgttatttaggttggagtgtagtggtgtaattatagtttattgtagtttcgaatttttaggtttaagcgatttttttattttagtttttcgagtagttggggttgggtttataggtgttattatatttagttatattttatatttttttgtagagatagggttttgtaatttgtttaaattggttttaaatttttggttttaagtaatttttttatttttagttttataaagtgttgggattatagatgttagttagtgtatttagtagttattatgattgattggtgacgtttgttttagttttaggatgaaagagtagtagtattttagttaagtatttgtggtttttgattggaagacgttttttttgttttttaagtatagtgtaaatgttatttttttggtaagtttttttttaattttattttttttttggtatagggtttgttatagttttgtttatataaagagagttattagtgtatgtggtatagatgttagttgtttttttaatatttgagtttttttttttttatagtaattgaagttttggttgtgtatagggaagtttagttgaagaatatattgtttagtttttttgatgataggagcggttatataattgggttttggttagtgggaaggagttgaagtgtttaatttttaggttatgtttttaaaaataaagagggatatttgttttttttttttttttttttttttttttttttggttggagtgtagatatgacggtaggagttggaattattttagtttaagagatggaagttgtgtgtcgaggatgtattaaaggaatgaattaggttcgggttgttttgggtttttataacgattgatatttggattgggacgtgggttcgagtgttgtttagtttttgatgttttagtttttgttatatagttagatggtgttttgattaatttaaggtatggttattattttatttgtttggtagggtaggggttttatttttatacgttgagtttttggtagaatttggtgtaatatatatagttaaagtaaaatgaataggttattttaattaaggtttattttgtgggttggttttggtatttggttttaatttttattttattttatttatttattatttttgagatagagttttatatttgttgtttagtttagagaggagtggtgcgatttcggtttattgtaatttttattttttaggtttaagtgattttcgtgttttagtagttgggtagttgggttttttttgagtagttgggattataggtgtacgttattatgtttggttaatttttgtattttttgtagagatggggttttattatgttggttaggttggttttgaatttttgattttaagtgatttattcgttttggttttttaaagtgttgggattataggtatgagttatcgtgtttagttagttttggtatttggaattggaaaataatagtttgagttttagaggggataaatataaatatgaggtagaaggaatagtaagtaaatacgtgtttagagtaggttgggttgtttatatttttaaaatatcgttaggtgttgaggtttgggttttgtgttagatttttgggtgtagatttcgtggggatatttattgggtagtgggatttttggtaagttatattatttttttgagttttcgttgattaagttgtttattgagaataatatttagattgaaaggatttataataatatgtgaaaagtgtttggtttaaaataggagtttggtaattggtagtttttattatttataatatatagtttaacgttttcgttttataggaatgaaaataggatttagataggtaaaatgatttgttgagggtcgtatagtgttaatgatagagttaggattagggtttggggttttgattttttttgtagtattttggttttgtgagaagtggttttgggtgaatataaggagtgaggagttggtgagaaattttgaaaatgaagttgggtgtggtggtggatgtttgcggttttagttatttaggaggttgaggtaggaggattgtttgagttcgggagttggaggttgtagtgtgttatgattgtattatcgtattttagtttaggtgatttagtaagattttattttagaaaaggaaaggaaaggagaggggaggggaagggagggaatttttgatagtgattttagagataattaggatgatttgaaattattttgaaatgtattaaaaaataaaaataaaatggatttatggttaggcgaaggagggatagatggacggtgaggtgataaagtaggtgtagtttggtgttagtggtagaatttaggtgatggttgaatgtgttttttgtaaaatgtttttaatttgattatgtgttttgaatatttttataatagaatggagggaagagaaaggtaagagggagttattgtagttgttgtagtaggagtagattttaaaatattatgtattagatttttagttttgtttttgtggatgtgtttttgtttttttttttgggatttaaggatatttaatgagcgtatgtgtttttaagtttttttgtttttttatttgtttttatatttggaagattttataggtggcgtgggttagttttttattttgttttttgtgtttttagtgtatgatagatattgagtgagtgttagttttttttttcgatattttgtttgtttgtttagagaggtttttttatagtttagttattaggttgatgtttttggacgtttggtcgatagtttttttagttgtgttttagtgatttggtaggtgttttgagttataaataaggttattagtggatgtttttaaagttttttttattacggcgttttttttttttttattaatagttcgttatgatagttagtttgtatgagtttttttttagggttgtgttttttgaggttgtttagcgtttggtttgttagagtttattagatagggtgtttattttttttaggtttgagtttttatttagagaattatttatagaaggataatggagaaaggtagttggggtattaaatggagtgtgtttgtatgtggggggggaggggagggggagggaaagtaggaagagaagatataagaggagaaataagaataagaggaaatatagaaggaggaggagtagttttttttatgggggtggattttgtgtttagttttttattaaggatattatatttattatttcgtttggtttttacgaatatttttaaggtcgtttttttttggtttttatttttttattaggaagcggaggtatagagtgagaaagagttgtttaaggtttttaggtagtttacggagttattgggagttatatttaattcgtttaattttacgtttttgtttttagttattataataaattattaaggttttatagttataggagtttagttcggagtttttatcgggttttttaaggtagggagatggggttggaggttatgttaggtgtacggtgtttagagttgtttaggaagtttcgcggtgcgggttgggtattaggtagtgtttgtaggatggagaaatgaatgaggttgagatatagtgtcgttttttttaaacgtgattttttttgagtttttgtgattggttatttgagagggtagttttggttttttggcgtttatgttcgggtttagagatgttttttttagttaggtttttttttgaggatggaaatttagaattttattataggaggaagagttgggagtattttattttttttttttttttgagacggagtttcgttttgtcgtttaggttggagtgtagtgacgcgatttcggtttattgtaagtttcgttttttgggtttacgttatttttttgttttagtttttcgagtagttgggattataggtattcgttattacgttcggttaattttttgtatttttagtagagacggggttttatcgtgttagttaggatggtttcgattttttgattttgtgattcgtttatttcggttttttaaagtgttgggattataggtgtgagttatcgcgttcggttagggagtatttttaagatttttgcggagggttgtttaggtttaagttttttattatggaaggttttttagatgcggtagttacggtgtatgggttgagggtttttatttattaagaagtaggagtatttgatgtatatttagtttacgatttttatttatttgggggttgtgtttgtagttacgtgatataagggaatagttatagtagtgggttataaagagagtgtgggttaatgtgtaggggtagaattttgatagttttttatgggttggtagtagggaggggtatatttgtataaattttatacgtatagttttttatatatatgtggttgataattatttatatatttaagacgggatttggcgtatagtttattagtaataggcgttggtaatttttagttgtttttttgttgcggcgtagatattatttaaggtgggatggagagagttattgtttttaaggttatatattttaaagggagatgttgggttacggaatgaaaataggaggattagttagagttattggttttgagttatataatgggatatataggtttatttattttatatttttattgagtaattataacgagttaagttgtatagattatttaaataatcggtacgtagaaaagtattttaatttttttttggttttgacgtgatgggaagaatttggatttttggagttatagagttggatggaaattttggtttagttaattattggttgggggagttcgggtaagtgatttaaggtttttgagtttgtttttttgtaaaagagtagtgttcgggtttgttacgttaggttagggtaagatgattgaagagtaagcgtttagtatcggttaggggttaacgtttttaaggacgtaaagtgtaataagtaggcgttacgattgtatcgttttttattgtttgtggtaaatatataagtaaagatggtttcgcgtttgcgttgggggaggtagggaattggttttaggaggacgttggtttttttagttgttttttttaaagttttttgggaggagaaatgatttattttagttgttgggagttttaatttataagtaggtttgtttattcggtagcggtcgtatgtaggtaggaggggtttcggtagtttttaagagtgaggggtcgtttagtttttttttagttggaaaggaggttttaggttgggtaggagtatttggggaaatttagtttttggagttaggttatattagggagatgaggttgttagaagtttttttggtgtttatagtaaaatataattaaagtgggatttagattttaattagtttaaggtttgatttatattagagggaaattagcgtttgtcgtatgagtgagcgtttatgtgcgtgtaaggtagagatagattttgggtaagtttttttatttttttacgtttgtttttttatttataaaacggggtaatattatttattttatagggttgttatgaaataaatatgtattaatatttgtaaagtgttgagaatagtatttggtataaaataagagcgatagatttgttaaataagtaaaaaataagatataagtttaaagtagagtttggtatatcgtgagtattaagagttgtgttttttgattttttttttttgtggagatttttttattagaagtgggagggattgtcgaggttggagttttgttttagggatttttgtggggagttttttagtttagagggatttgttttacggattatatttgtttcgggttttcgtgtttttgtgtatgtgtgtatatatgtgtgtatatatatgtaatgtgcgtgtgtgtatttttatggatttgtgataatttgtatatatatgtttagaatttatttgatatagtgttttattaagatgttggagtttcgatgaatggattgcggggttgagatattgtttttataggaagttgttttagtagtaagttttttggtttttatagataattaaaaagaatggagtttgtttttattttttgttttaaaaatgatgtatagtgtgtggggtttgatgttggaggtttttttagtagatatatttttaataatattatattttgaaatttaagttgtcgtaaaataagataagtaaagatggtattggtagggatttttgaggttttttttatgtatttttgaataatttttatatggtttttgtttgaatgtttttaggtatggggaatttattattttgtgaaatagtttgttttatcgtttttaagtgaatattgtgagaaaaatatttttttttgtaaagagttaagttttattcgttagtattttttaggtatttggtattagttttatattttgggggaatttaaaataaatgttttttttttattagataatttattaattatttggagatagtggttgtagttttttgttttatgtagttattttatttagtttttttttggaatttttgacgtgaatataagtttttttgttacgtaggttttttttttgggttttttatttatttgcgtatattttggagaggtcgttcgttttgtgggtgagatttattgtgggttgaattgtgtttttttaaaagatatatgtaagttttgattttttagtatttatgaatgtgattttatatggatatagggtttttgaagatgtaattgggttatttgagggtatattgaattagagtgggttttaaatttaatgataggtgtttttataagatagaggtaggttgggtatagtagtttatgtttttaattttagtgttttgggaggtaaagttttattgtttgagcgtaggagtttgagattagtttgggttttcgtttttataaaaaaattaaaaaattagttaggtatggtggcgtgcgtttgtgttttagttatttggaaggttgaggtgggaggattgtttgagtttgggaggttgaggttgtagtgagttatgattacgttattgtattttagtttggaggatagaatgagaatttgtttttaaaaataaattaaaaagataatagagagggtagtttggatagagatataagaagagatatagggtgaaggttaggtggggggtaggtcgagttgtaagtcgaggaatattaggggttgttggtcgtcgtagagttcggagaaaggtatgggatagtttttttcggaatttttaggaggaatgaatttttagatatttcggtttgggatttttggttttagaaattttagggaagatatttcggatgtttttgtttttgtttttgtttttgtttttgagacggagttttgttttgttatttaggttggagtgtaatggcgcgatttcggtttattgtaatttttatttttaaggtttatgttatttttttgttttagttttttgagtagttgggattataggtatttattattacgttcggttaattttttttttttttttgtatttttagtagagacggggttttattatgttagttaggatggtttcgattttttgatttcgtgatttaatcgtttcggttttttaaagtgttgggattataggtatgagttatcgtacgtggtcgatttcggatgttttgagttattttatttgtggttttttgttatgatagtcgtaggatagtaatatagggttttagtagggtggttcggtaagggttttttttttacggtagtttttattttgttttatttgtagggttatttagatgtttatttcggttttggttagtaagtgttagtgtatttttttacgtttagtagtaagggtagtatcgttgttgattaagtatttgttatgtcggggtttttgtgtggttttggggttttttttttttgtttatatttggtagtttagtttttttttttgtattttatttgatgtcggggttttgggtaagtttgggggatttgtgttttattttatagattttttagttgattttattagtttttgtatagggttcgtttgaagggtcgttgggttgggcgttaattagagtttttagtagtagttttttcggttttttgattttggtttatgttttaggggtagggtttttaagggttttggggtcgtttttgaggttagtttttttgttgatcgtagtttatatagaggagggtttaattttgagtgtggtcgttcgtgattttgagagatgtttagagttgtagacgtgttttttaagttttttagagttcgggataggagttatttaatgtttttagtgttataggtaaaatttgttttttttaatataaattgtttttagttttatttaatgttttttttaacgagtagtaataaaaatatggttttttgttaaaggtggggtttatagttttttagaattcggttttttgttaggtttaggtataatttataggagtgttcgtttttgattcgtgtgtgtgtgtgtgtgtgtgtgtgtgtgtgtgtgtgtgtgttgtgtgtacgcgtatatgtgtttgcgtaagtttttttatgtgtagttttgggaagggtggagaggtttacggaaattttttttggtatttagtaagttagaaaaaaggaaaatgagatttgtgtatatatgtgtaagtgtatatatagtatataggtatatatatatatatatttagtatatattatataggtttatacgtgtatatatgtgtaggtatatattatataggtttatacgtgtatatatatgggggtatatagtatataggtatatataggtatatatatttttttgtaggaaagtttttttttgttttttattttgtagggtttttaggttttatgaaataagattgaattttggaagtttgataaaaggtttgtttggagtattttggttatttttattagtttttttagttgtggaaggtatgtttcgtggtatttatttattttttgtttttatttttattttcgttttcgtttttttttttttgtttttttagtttatatgttgtttgttttaattttaatttttgtatttggacgggaattattttttttgtagaagggtgtaatgtatgtggggatatatatatatatatatatatatatattgtattggaggagagaagagaggtagagttttttttagatttagagttttagcgagtgacgggattttttttagagaatacgtgtagaagtttgcgttattggaagaagatattattttgatttatatttttttttttttttttcgttttttttatagagaaggaaaggttttagtaaatagtggttatgtgggttttttgtatgttattggtagttttttagttaggattattttttttttatttttggaagtataagaatagagagaagggtgagtttttgtttttgggggtttttttttgtatttttttggagttaattttagggttgtgggttgtataggaaggagggtttaataggtttttcgtttaattttgtttttttagtgaggagtcgatttattttgtttgtaaaagatgttggttgggatttgatgttgggtaatttgaggagaagagaagggggataggggttgaggttaggtttttggttttgaaatagttataatttttggggtagagtttaagggtgttaggttggagattttatattcggttagttggtagttattattttggtttagttagtggtttagggtattatagttatttagattaggaattttatttttttggattgtattaatgaggaaggttgagtttgtaggttttatatatttatggtaattttaaggtagagaggttattgttaattgagggttacgggtaggagttttgtgagtttattagtaagtttggaagattaaggtttttggttatagagagtagttgttatttggttaattttgtagaaaatattatagttttggataaaatatttgaaagaataaaataataatagtttggagttagtatagaatattttaagtaggtagaagttggagtagagtttatatttgatagaggggaataaaattagataagtttttggtttttggaggtttttttgtttagaggtaggtattgagtaattaaatttggataaaaagttttaaaagtatttagggaaaaataatatgtggtttataggggaatagttagatgaatgttgattttttgatagaaataacggaggttaaagatattggaattttatattttaaagttttgaaagaaaaaattgataatttagaattttataattagtgaaattatggtttaagaatgatagtaggttgggtatagtggtttatatttataattttagtattttaggaggttaaagtaggtagattatttgaggttaggagttcgagattagtttggttattatggtgaaattttatttttattaaaaatataaaaattagttgggtatgatggtatatgtttgtagttttagttatttgggaggttgaggtaggagaatcgtttgagttcgggaggagaaggttggtgagttgagattgggtaggagttttgaaattatattattgtattgtagtttgtggggagatagagtgagattttgttttaaaaataaaaataaaaataaaaaaagaaagaatgatagtaaaataaagatttgtagataagtgaaaatgaaagggaattagttgtttgtaaatttgtattataaaaatcgtgaagtaagttttttaagattatgggaaatgagattagatgggaatttagttttttaggaaggaatgaagagtataggatatagtaaatatatgggtaaatagaaaagattttgttttatttttaatttttttaaaatgtatggggttgtttaaagtaaaaatttttttattgtattgtttagtttataatgtgtatggatgtagtaaatatttaataattattatatataggatggaaagtggtaaatgaatttataggattgtttagtttttatattttttttttatgaagaaaaataatgttaattttaagtagattgtgaaaagttaagaatgtgtaatagaatttataaagtaattattaaaatagtaatataaagagatataattaaaaagttaaaataggtcgggtttagtggtttacgtttgtaattttagtattttgggaggttagggtgggcggatcgtttgaggttaggagttcgaggttagtttggttagtatggtgaaatttcgtttttattaaaaatataaaaattagtcggtcgtggtggtaggcgtttgtaattttagtatattagggaagttgaggtaggagaattatttgaatttaggaggtagaggttgtagtgagttaagattatgttattgtattttagtttgggtaatagagtgagattttgttttaaaaaaaaaaaaaaaaaaaaaatataaattaaaatagaattttaaaaaatatttaattaatataaaagaagttaagaaagtaagatgaaagaaataaatattaaagagtaaggtagtagttttaaatttagttatatttataattatgttaaatagaaatagtttgaatattttaattaaaaggcggaggttgttagaatgaataaaatagtaagatttaattatatattatttataaaagatgttgttttagtataaatataggttgaaattttttgtttggaaaaagatatattgatgttgtttgaatgatgatggagttatgttttgataaatttattataagtggaaaataaatattattttaaaaatgtatttaatatatttaatttatcgaatattttagtttagtttagtttattttaatatgattagaatatttattttagtttatagttgagtaaaattaataaatataaagtttattttataataaagtgttgattattttatgtaagttattgaatattgtattgaaagtgagaaatataatggttttatatatatttaaagtatagtttttattgtatatatattacgttcgtattatggtaaagttgaaaaattgtaagttaaattattataagtttttttataagtttttttagtttttttatgtattttaaatagtatgtttaagaaggttggagaggttatataaatattaataaagttgagtttaagataaaattattacgagataaaggaatatatttattatggttaaatgattagtttatcgagatattattataattataaatgtgtatgtatttaattaaaggagttttaaaatatatgatataaaatttgaaagaattaaagggagaaatgggtaattttataattataggtggagattttttttttttttttttgagacggagttttatttttgttgtttaggttggagtataatggtgtaatttcggtttattgtaatttttattttttgggtttaagcgatttttttgttttagtttttcgagtagttgggattataggagtttgttattacgtttagttaatttttgtatttttagtagagataaggttttattatgttgtttaggttggttttaaatttttgattttaggtgatttattcgttttggttttttgaagtgttgggattataggtgtgagttattgcgtttggatgtatagttggagattttaatattattttagtttatttaggatgttaaaataaaatgttttaggttgggtaatttataaatagattgtagtgtttatagttttagaggttgggaagtttaaaattagggtgtttagtgtttggtgagagttagttttttgttttagagatgttttttttttgttgtgtttttatatggtagaagggattaattttatttacgatgattttgtttttatgagttaatatttttttgatgttttaatttttaatattattgtattagagattaagttttaatatatgaattttgggggatataaataggtaggttatagtaaatattatttttttaatatttgagaaataagtattagataatttgaagaatattggtaattagtaattgatttaattagtagttataaagttttatatttaggaagtttagaatatatatatatattttttttttaagtgaaaatagtgtatttattaagatatatattttgggttataagttttaaattttaaaagtatgtaaaatatgtttgtttggttaaagtaagattaaattagaaattaatagttttaagatatttagaggagttttgattatttgtaaattaaataatatatttttaaataatttatgagttaaagaggaaattataagaaaaattttataatattttaaatgaaatgataatgaaaatatagtatattaaaatacgtaggttgaagttagtgtttagagggaaattgtaagtgtttatattagaaaagaagtaaaaaaaaaaaaaaaaaaaaaaaaaaaaagatttaaggatttgttttaagaatttggaaaaatgggttaggtgtagtgtagtttacgtttgtaattttagtattttgggaggttaaggtaggtggattatttgagattaggagtttaagattagtttggttaatatggtgaaattttgtttttattaaaaatataaaaattagttgggtatggtgggtatttttagttatttagaaggttgaggtaggagaatggtttgaattcgggaggtggaggttgtagtgagtttagattatgttattgtattttagtttgggtaatagagtaggatgtttttttaaaataaaataaaataaaataaaataaaataaaataataaaaaaaataaagaatttggaaaaatatgttagttatttatgtattgttttttaattttgtatatattttgttaggtttcgtttcgtgatattggatcgaggttttatgagtttttttttttggttaaatatagttatgttaggttttatttataggggataatattgtggggagttgttaggttttgttgaggtagtagtttttttttttggttttagggttttttttttttttgaaggtatagttgttagtggcgtgtgtttagtggggtttgttttgtattgagtttttttagtattttagttttagtttaatgggattttagtaaattttttagatatttagtttttgtttatttatattttttagtaggtttttcggttatttagtaagttgattttgtagatttattttttttatattttttggtaagaatttttttgttattagtaggttgtaggtttttgtggtagttatatattttttaataaggtttgaacgtaagacgtggtaaggtgtggaggacgtttcgagtttttggttttttttttattaattttagtggtagtaattgtttttgtgtgtttgtatatatgttttaaagtatttattatagaaaatttattattttaattatttttaggtgtgtagtttggtggtatgaagtatatttatattgttgtgtaattattattattatttattttatttttttaaattgtaattttatttttattaaatattaattttttatttattttttttttttttagtttttggtaatttttattttattttttgtttttttgaatttgattattttagggattttataaaagtgaaattatatagtatttgtttttttatgtttggtttttgttatttagtatgtttttaaggtttatttatgttatagtatgtgttagaattttttttttttttttttttttttttttttttgaggtagttttgttttgtcgtttaagttggagtgtagtggtatggtttcggtttattgtaatttttatttttttagtttaagcgatttttttgttttagtttttttagtagttgggattataggtatatgtttttatgtttggttaatttttgtatttttagtagagatagggtttcgttatgttggttaggttagttttaaatttttgattttaagtgatttgtttatttcggttttttaaagcgttgggattataggcgtgagttattatatttggttttttttttttttttaaggtagaataatattttattgtatagatggattatattttgtttgtttatttattcgttggtggatatttgggttgtttgtattttttggttatgggaaaagtgttgttataaataagaatgtagtatatttgtttaagtttttgttgttagttttttggagtatatatttagaagtggaattattggatgttatggttattttgagtttaattttttgagtaattgttatattttttttatagtagttgtattattttatatttttattagtagtgtacggggttttaatttttttatatttttgttaatatttgttgttatttatgttttggttaatagttattttaaagggtgtgaaattatattttattgtggttttgatttttatttttttgatgattagtgatattgcgtatttttttttgtgttttttggttattggtatgttttttgtggaaaaatgtttgtttattgggttgtttttttttgttttgtggtttagttgtaggagttttttatatattttggatattagttttttatcggatatacgatttttaaatatttttttttattttgtggattttttttttacgttattggtagtattttttgatgtataaaagttttaagttttggtgaagtttaatttattatttattttttttgttgtattttcggtgttatatttaagaaagtattgttaattttaatgttacgaagttttttttttatgtttttttttaaagtagttgttttttatatttgttttttttatattttttagagtttttttgtataaggtaaaataaattttatttttttatttttatttataatatttagtgttttagttttgatattagatgtgtggttttttttcgtcgatttttaagtaattttttaatatttagtagtttttaattgggtgttttgtaatttagtttaattttgatattaattagagttagtgtagattttataggttaagggttttattttataagattgtttttaattttagagattagtcgtaagtggtaagatattaggttatttataatttttgtttgatttggttataaatttgaggtttttataattttttttttaggtttaataatttgtttgagtgatttatagaatttaggaaattagtttatttaaaattgttgatttattataaatgatattttaaaggatataaatgaatagttaattggaagagatgtataagaaaggtatgaaggaagcggtatggagtttttacgggagggtatattgtttttttagtatttgtaggtatttaataatttgaaattttataaattttatttttttgggtttttagggaggttttattatataagtatgatatgaaatttttggttattgatgattaatttaatttttatttttttttgtttcgtaggaggtggatgggaaaggttgtaagttttagttttttaattataaggttgggttttttggtaattagtttttatttttaggttgtttaggagtttttagttattagtcgtttttttagtaaataaaaagatatttattattttggagattttaagagttttaggagttatatgttaaataaagttgggggatagagattagatagatagatagatagatagatagatagatagatagatagatagatagatagatatattgatttttgagatagagtttttttttgttatttaggttggagtgtagtagtgtaatttcggtttattataacgtttgttttttcgggtttaaattatttttttattttaattttttaagtagttggaatcgtaggtatatatcgttacgttaggataattttttgtatttttggtagatatgaggttttattatgttgtttaggttggttttaaatttttgagtttaagggattcgtttgttttagttttttaaagtgttgggattataaatatgagttattgtatcgagtttagtttaaatatattttttttatattataatgttatttttttgtgatttttttaatagttaattattttttatagttaagaatattttatattataagttgttatttaaattgtcggtgtggtttttgttttttgattgggttttgattaatgcgttgaagtaagtataaggaaggaagtaatgaagataatagagaaatttaaggaaatggatattagaaaaggggagtttaatgttggttttttaaaaagatttagattgataattttttagttaggttgttgatgagagggagatggcgaatataaagttataataaaaggaatgaagtgttttttttacggattttatcgatattatagtgataaggaatataggtatattttattttattgtgttttatagatattgtattttttataaattgaaggttcgtggtagttttgtattaagtaagtttgttggtattatttttttaataatatgttaatattgtgtttttgtgtaggagtttgatgatttttgaaatagtttaaatttttttattattattatatttgttatggtgatttgtgatttttttttttttttttttttttttgtttttttttttttgagatagagttttgttttgtttggagtgtagcggcgcgatttcggtttattgtaagtttcgtttttcgggtttacgttatttttttgttttagtttttcgagtagttgggattataggtatttattattacgttcggttatttttttcgtatttttagtagagacggggttttatcgtgttagttaggatggttttaattttttgattttatgatttgttcgtttcggttttttaaagtgttgggattataggcgtgagttattgcgttcggttttttttttttttttttgagatggagtttcgttttgttgtttaggttggagtgtagtggagtgtagtggtgtgatttcggtttattgtaatttttattttttaggtttaagcgatttttttgttttagtttttttagtagttgggattataggtattcgttattacgtttggttaattttggtatttttagtagagacgaggttttattatgttggttaggttggttttaaatttttgattttaggtgatttatttgtttcggttttttaaagtgttgggattataggtatgggttatcgcgtttagtgattagtgatttttaatgttattattgtagttgtttttggggtatgacgagttatatttagataagatagtgaatttatttaataaacgttgtatgttttgattgttttattgattggttgtttttcgttttttttttttttgtttaggtatttttattttttgagatttaataatattgaaattaggttaattaataattttataatggtttttaagtgtttaagtgaaaggaagagttattcgttttttattttaaattaaaagttagaaatgattaagttgagtgaggaaggcgtgtcgaaagttaagataggtaaaagtgagattttttatgttaaatagttagttaagttgtgaatgttaagaaaaagttattgaaagaaattaaaagtgcgattttagtgtatatatgaagaagaagaaagtaaaatagttttaatgttgatatgaagaaagtttgagtggtttggatagaagattaaattagttataatatttttttaaataaaagtttaatttagggtaaagttttaattttttttaatggtatgaaggttaagagaagtgaggaagttggagaaggaaagtttgaggttagtagaggttaggttatgaagtttaaggaaagaagttatttttataatgtaaaagtgtaaggtgaagtagtaggtgttgatggagaagcggtagtaagttatttagaagatttagtttagagtattgatgaaggtggttatattaagtaatagaattttagtatagatgttttattttttattggaagaagatgttatttaggatttttatagttagaggggagaagttaatgtttgtttttaaagttttaaaggataggttgatttttatgagaggttaacgtagttgttgatcgtaagttaaagttaatatttattgatcgttttaaaaattttagggtttttaagaattttgttaaatttattttgtttatgttttagaaatggaataataggttttatttgatagtatatttgtttatagtatggtttattgaatattaaaaatttattgaggtttggtgcggtaatttacgtttgtaattttagtatttttgaaggttggggcggggggattatttgaggttaggagttcgagattagtttggttaatatggtgaaatcgtatttttattaaaaatataaaaattatttaggtatggtgttatacgtttgtaattttagttatttgggaggttgaggtaggagaatcgtttgagtttaggaggcggaggttgtagtgagtcgagatcgtgttattgtattttagtttgggtaatagagggagattttgttttaatttgaaaaaaaataaaaaaataaaaaagggttaagtacggtggtttatagttgtaattttagtattttgggaggttaaggtaggtaaattatttgagtttaggagtttaagattagtttggttaatatggtggtgaaattttatttttattaaaaatataaaaattagttaggtatggtagtgtatatttgtagttttagttatttaggaggttgaggtaggagaattatttgaatttgggaggcggaggttgcggtgagttgagatagcgttgttgtattttagtttaggtaataaagcgagattttgttttaattaaaaaataataataaaaaaaaaataaatagggttcggtgtagtggtttatgtttgtagttttaatgttttgagaggttgaggtaggtggattatttgaggttaggagttcgagattagtttggttaatatggtgaaattttgtttttataaaaaatataaaaattagttaagtatggtggtgtgtgtttgtaattttaattatttaggaggttgaggtataagaattatttgaattcgggaggtagaggttataatgagtcgagattatgttatcgtattttattttgggtgatatagcgagattttattaaaaaaaaaaaaaaattattgagatttattgtttaggaaaaaagaatttttttaaaatattattgtttattgataatgtattttgtgatttaagagttttgacggagatgtatgtaaagatgaatgttgtttttatgtttgttaatgtaatatttattttgtagtttatggagaagggataaatttgatttttaagttttattatttaagaaatatattttataaagtagtatttgttatagttagtgatttttttaatggatttgggtaaagtaaattgaaaattttttggaaaggattttttattttagatgttattaagaatatttgtgatttataagaagaggttgaaatattaatattaataggagtttggaagaagttgattttaatttttatggatgagcggtttaagattttagtagaggaagttattgtagatgtggtggaaatagtagagaattagaattagaagtggagtttggagatgggattggattgttgtaattttatgattaaatttgaatagatgaggagttgttttttatggatgagtagataaagtggtttttggagatgggatttattttaggcgaagatgttgtgaatattgttgaaatgataataaaagatttagaatattatattaatttatttgattaattcgtggttagggttgaaagaattgattttaattttgaaggaagttttattgtgggtaagatgttattaaatataatgcgtgttatagaaaaattttttatgaaagaaagagttaatttatgttaaaaattttagttaagaaattgtcggttaggtgtagtggtttacgtttgtaattttagtattttgggaggttaaggtaggtggattatttgaggttaggagtttgagattagtttggttaataaggtgaaattttgtttttattaaaaatataaaaattagttaggcgtggtggtaggtatttgtagttttagttattcgggaggttgaggtaggagaattgtttgaattcgggaggtagaggttgtagtgagttgaaatcgtgttattgtattttagtttgggtaatagagtaagattttgttttaaaaaaaaagaaaaagaaaaaagaaataaagaaattgttgttatagttatttttaatttttagtaattattatttggttagtagttattaatattgaggtagattttttattaagaaaaagattatggtttgttgaaggtttagatgattattagtattttttagtaaaaagatataatgattttatatattttaatagattatagtatagtgtaaatataattttttttttttttttttgagatggagtttcgttttgttatttagtttggagtatagtggtgtgattttagtttatcgtaatttttattttttaggttcgagtaatttttttattttagttttttaagtagttgggattataggtatgtgttattatatttagttaatttttgtatttttaatagagatgaggttttattatgttggttaggttgtttttaaatttttaattttaaatgattcgtttattttggttttttaaagggttaggattataggtatgagttattatgtttggtttaaatataatttttatatgtattgggaaattaaaaagtttgtgtgacgtgttttattgtaatatttgttttattgtcgaggtttggaagtaaattttaggtatgtttgtattacgaataattttaaatgagtaaatttaataatttatttgaaagggataaatttttttaaagtataatttattaaaagtaagataaggggaagtaaaaaaatttgaataattttttttatatattaaattgaatttgtgattaaaaataaataattattttttttagtagaaaattttaggtttagacggtttttttggtggattttattaaatatttaaggaagaaataatattaattttatgaaaatatagaaaataaagagaagggaatatttttaaattaattttatgaagttaaaatgaggttgataaagatattatcgaaataaattaataaataaagaaaatattatattaatattttttatgaattaatacgtaaaaatttttaaaaattgggtaaattaaatttagtaatatataaaaaggatgatattttataagtaagttggattttttttagaaatgtaaggttggtttaatattaaaaaattaggtttgtatagtggtttatatttgtaattttagtattttgggaggtagaggtgggagtattgtttaagtttaagaattgtagattagtttgagtaatataatgagattttatttgtataaaaaattttaaaaattaaaaattagtttggtatggtggtatgtgtttatagtttttgttatttaggaggttgaggtgggaggattgtttaagtttaggagtttaggttgtagtgagttacgatggtattattgtgttatagtttgggtaagagtgagattttgtttttttaaaaaaaaaaaaaaaaaaaacggggggtaaaaattaattattgtaatttattttattaaacgaataaaagataaaataatgattatttttatagatgtagaaaaagtatttattaaaattatatttatttatgttaaaaaattttagtaaattaagaatagaagggaatttttttaatttgataaaggttatatatgataaatttaaagttaatattataagtttggtataggtaaggatgtttattaattattattatttaatattgaattggtagttttaattagtgtaataaagtaagaaaaaaaaataaggtattaagattagaaagaagtaaaattatgtatttaaattttaaaagatttataaaattattattagagtaataaatgattttggaaaagattataggatataagatttatatataaaaatttattgtatttttatatattagtagtaaataattaaaaatgaaatttaaaatttattttagtttaaaatagtgttaaaagtaaaatttttaggaataaatttaataaatggtatgtaagattttttttttgaaaattataaaataatgtaattttgtagagatttttttttagtagagaaataaaagaaatataaaaggatttttaaaacggagatatattatttatataaaagatttaatattgttaaaatgttaatttttttttaattgatttatagatttaatataattttaattaaaatttatattgtatttttgtagatattaataagttattttttaaatttataaggaaatttaaaggatttagaatatttaaagtaatattttagatatttgagagattttatattaagatttattgtaaagttatattaattaagatgtggtattagtaaaggaatggataaaatattaagaaaatataatagtgttttaatatagggtttatatgtatatagtatatatattaatataggattatatatatagttaatataggatttatatgtatatagtatatatattaatataggattatatatatagttaatataggatttatatgtatatatgtatatatattaatataggattatatatatagttaatacggggtttatatgtatatatgtatatatattaatataggattatatatatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatggggtttatatgtatatatgtatatatattaatataggattatatatatagttaatatagggtttatatgtatatatgtatatatattaatataggattatatatatagttaatatagggtttatatgtatatatgtatatatattaatataagattatatatatagttaatatggggtttatatgtatatatgtatatatattaatataggattatatatatagttaatacggggtttatatgtatatatgtatatatattaatataggattatatatatagttaatatggggtttatatgtatatatgtatatatattaatataggattatatatatagttaatacggggtttatatgtatatatgtatatatattaatataggattatatatatagttaatatagggtttatatgtataaatgtatatatattaatataggattatatatatagttaatatagggtttatatgtatatatgtatatatattaatataggattatatatatagttaatatagggttgatatgtatatattaatataggattatatatatagttaatatagggttaatatgtatatacgtatatatattaatataggattatatatatagttaatatagggtttatatgtatatacgtatatatattaatatagggttatatatatagttaatgatttttagtaaaggtgttaggtaatttaatagagtaaggtatgtttttttaataaacggtgttagaattggatatgagtatagaaaaataagaattaattttgattttaaattaaatataaaaattgatttaaaatggattatataatattttgacggttataataggttaaaaaatgtaaaaatttaaaaaattaaaaaataaaaggaattatagaatatataattataaaatttttagaaaataagagaattttttttgattttagtgtaggtaaagattttttttataggttataaaaattataaatcgaaattggaaaaagttgataaattggattttatgaaaataaaatatttttgtttattaaataatattattaagaaaattaaaaggaaaggagtaatgtggaaaaaaaaatttatgatatatatatttgataaaggatttatatttagaatatataaaaaatatatgaaataatatttttttttttttttttttttgagatagagttttgttttgttatttaggttggagtgtagtggtgtaatttcggtttattgtaagtttcgttttttaggtttatattatttttttgtttcggtttttcgattatttgggattataggcgttcgttattacgttcggttaattttttgtatttttagtagagatggggttttatcgtgttagttaggatggttttgattttttgatttcgtgatttgttcgtttcggttttttaaagtgttgggattataggcgtgagttattgtgttcggttaattttttttttaaatgagatttatggggaaatagttaaatgaagaaataataaagtagtaataaaataaaatttaagttttattttattgtgtagttgtaggataaagagtagaagtttgtagttggggaataaggtgtttatttttttaagtattataaaatgaaggttttagaaattattcgattttgaaataatataattttaaaaagaagtaagacgtggatagataattttataaaggaaaatacgtaaatgattaataaggattttggaaaattgtgcgattttataagttattaagaaaatataaaataaaagttttaaaaaaaaatgaagtttggaataattgaataaatatataaaacgataataaaatgaattttgattttttattttatattatatgtaaaagttaatttataaaagttatataattttaagttttttaaaggaaaatataaatatttttgtaatttggtagggtaggtaaaggttttttataaagaatatagagagagaattataaagaaaggagtttgttaaattagattttataaaaattaaagtgatatatttttgtttattggaaaatattattaagaaaatgaataggtcgggtatggtggtttatgtttgtaaaatcggtttttggggaggtagaggtaggaggatagtttgagtttaggagttttagatttgtttgggtaatatagcgagattttgtttttgaaaaaggaaagaaaatgaataggtaagttatagattggaataaaatatttgtaaaatacgtatttgataaaagattagtatttagaagaaaaagttaagtaatttaattttaaaatgagtaatagatttgaaaagatattttataaaggaaaaatatatgaagagttaattatgaaaatgtgtttaatcgtattagttattaggttaaagtaaattaaagttataatgagatgatattattatacgtttattagaatgattaagattttatagagtgatagtattaaatgttggttaggatgtggagtaattagaattcgtatttattgttggtgggagtgtgaaatggaagggttattttgggaaaagatttggtagttttttataaaattaaatgtatatttattttatatttattttaggtgtttttatagaataaatgaacgtttatatgtatagaaaaatttgtataagaagaattagcgtaataggtttatttataagagtttttagatggaaatagttaggggttttttaataagagaatgattaaaaatttatagaatgtttatatagtggacgttatttagtaataaaatagaataaatcgttggtatttgtagtaatatgggtagttttaagaaatatttaaattggtaaaattatttcgtggtggaaaaaaagtataattgtggttgttttggggaaggtggggattgtgatgtatttggaggggtatgaggaatttattggggtgatagtgatgttttatgttttggttaggttgggatatacgtggatatttttgttaaaatttaaagaacggaacgttttatatttgtgtattttagggtatatatattttattttaaagaaaaataaaaataattatagataaatgtcggattttagttaatgaaatgtaaattgaggtgttgataggatgttgtgtgttgatttttgtagtttattttaagtgtattaaaattagcgtggatgttggtggttagagggatttgtggtgaagtaaatagtaaaatggttgttgtggaatttaggtggtaggtgtatgggtgtttattttagaattttttatggttttttttttgtggttttgttttgttttgtttttgagatagggttttgttttgtcgtttaggttggagtgtattggtataattttagtttattgtagttttaattttttaggtttaagtaatttttttattttaatttttcgagtagttgggattttaagtttgtattattatgtttgattaattttttgtattttttatagagatgggattttattatattgttcgggttggttttgaatttttgggtttaagtgatttttttattttaattttttaaagtgttgggattatagttatgagttattatatttagtttttttttattttttttatgtttgaaaagttttacggtaaaaagttggaaaaatgtaaaaaagattgaaatttattaattaaaaataggaaaaataaaataaaagagatggtaggagattattttttttttttttaatttagtttttaatttttttttttttcgtttagttaggataggaattttaagggttcgggtttttcgtgtttgtgcggggaaggaggtattttcgtgtttgtgcgggggttggttatttgtttttcggtgtattttttgtattttattttttttcgttcgtagtgagtagttatagttggcggaaattatatttaggtagtttttgtttataaatttagtgaaaatgtaaatttcgtaggagttggattttcgagagtttgcggcgttatttgttggaggaaaggttttttgtattcgagttttttttttttttttcgttgttattcgtttttttgtttaggttgggcgggttttttttttgtaatttcggggtattggtgtacgggaaatgtttagtgttttataatttttttttatttatattttaatatttagtttttagtggatatcgttttcgttcgataaatatattatataggtatagtttaagattatttattttaggaggagtataagttttagtgtttattattttagtttttttttttttttttttgacgtagtgatataggtttaggatattgaagatttttgattttataaatatgttgaagttaattattttgaagttgtagtttttattattattattattttttattttttgtaaagataaagttttgttatgttgtttagtttggtttggaatttttggatttaattgatttttttgtttcggttttttaaagttttgggattgtaggtgtgagttattgtatttagtttgaagtcgtagttttttaattattgttaatagtaatatttatttttttgtgagtagtagggtttgttggtatggttgatagttttgtattattgtatcgaatttgttgtttgggattttaggtgagtttcgatttttagttggagggataagttgtgtggggttgggtagggtgaattgcgggagattaagtttagattgagggttataagttatatgagtattggggttaggtagggatagtgaaggagatagtgtaattttgaggaaagataacgttatagaatggagaggtttaggttcggggtttttttttgttgtcggataggtatgtttgtgttttttttttagttttcgtgatggttaagttatgtgttttttgagaggtaagcgaggtttttgatagtaggttttaggttttaattaaattgtttgttttgtagggtgagttgtataggtgtttttattttcgatttttttgaatttttgttgtttttaagttttatttattttttttaggtgaatagaaatattgtttaggggagaacggaggaagaatttaggaaaggttgttcgagagtttggttgagtttacgttatcgttaagagtagcgttaaaatttaggagttggtgagattatggtttagggtttatattaatatgagggggtgttagttttatgattaatgagtttttgttttattattttttgttatttatattttgagggttatagttagtacgtgaattggagttggttttcggtatttttttttttatattagttttataatgtgaggtgggggttcgtttttagaggtattcggagtagtaggtgttttaagagggggaagttttttcgaagtttttttttatttacggtataggacgtagaggggatagagtattaggaatatttagcgattataggggtttgtttcgaaggagaggaggtaggaggtagggagagtggttgggaggttagttttggagtgtttattttttatttcgagggagaggaaggaagtagaaggtgagtatagggagttttagttggggatggagcgggggttgtagttcgattgtgttgtttggagcgggggtatggattgtagtttttatttatttgtttggttagttcgaagttattttaagtttggagattttatttgttttgtttattttttttagggatggtgtttaaatttcgaagttttggttggtgttgtaaatatgggagggaggttttgttttattttagttttaagagttagttaagaatgttttggatatttgaattttgtttcgagttagaggttgggaagaaatttgaaggatggtgggacggtggatagtagtttttaggtattaggtattagggtttttgtttggggatgggggtattagtaggtgttaagtgtattatattagggtttattatgtttttgtttagagatttagtattttacgaaataggaaggaacgagggatgagcgtgtttttttttttaatattttagtttttgttttgaggttgttaggtatttaatttttttaggatttaaattattttggttttatttacggttaagtgtattaaattatagttaggattattgggtttagatattaaaagcgttttttttaaagtcggtagttattagggtagtatagggtagtgtaaggttgggtagggtcggttatttgttagtatttagtggtttttgttggatgttgacgggggtagttaggtaggtgggtttatttagtaattaaagagattttttttttttaattttttttttaaagagattttgattttttttttttagttgtagggtttgtagtagttttttttttagtaggtttttttgtttgtttttggttatttttagtagttatagggtattgaggttttattatagtgagaataaaattaagtttttattagggtttttaaggttcggtacgatttggttttgtttgtcgtattggtgttattatggttcgtttttgaaaatatattttagttatttttattttttttaggttttagtttcgggtttttatatttgttgttttttttgttaggttgttttttttttggattttggtttggttgggtttttttggttattatagttttagtttagtgttattatttagaaagggtttttattaattttttcgttatatatatagatatgtatttttagtaatttgtttttagtttttttatagtttttatttaaaattatttatggatttgtttatttgtggattgttttttagttttaattgttaagtaataagcgattagcgattgtgtttttgttgttttttattataggttaagtatttaagagaggggttgtatatagtaggttttaataaatatttattagacgggttaggtacggtggtttatgtttgtaattttagtattttgggaggttaagttgggtggattatttgaggttaggagatcgggattagtttgattaatatggtgaaattttatttttattaaaaatataaaaattaattaggtatggtggcggacgtttgttattttagttatttgggaggttgaggtaggagaatcgtttgaatttgggaggcggaggttgtagtgaggcgagatggcgttattgtattttagtttgggtgacggagtgagatttcgtattaaataataataataaaatatttgttagaagaattaaagtagtttgtttgtgtttaataggaatttaagagtataagatgaatttaattaaaggatatatatagtaggtattttatagttgatatttgttggtggagggagattaggaaagtggggagaggtagtgtttgggtatggggatattttgggtatggggacgttttggatatagggatatattgggtacggggatattttgggtataggacgttttgggaacggggatattttgggtacggggatattttgggtatggggatgttttggatatagggatattttgggtacggggaaattttgggtatggggatgttttggatatagggatatattaggtacggggatattttgggtatggggatgttttggatatagggatatattgggtacggggaaattttgagtatcgggatgttttaggtacggggacgttttttgttatttgaaatttcgtagttttattatattcgtttgttttagtaaatcggtttaaagagtatttttaagtttttatggtaaagttttagagttagtgttttttcgttgatttcgagggtgtgttgtttatttagtgtttaagttagagtttttttatttagaaaaaaaaagaggagggtggttttacggatggaggtatgagggcgtttataggtagagggagttttcgggttgagatttgcgttattttttgttttaattttaaggcgtagtttggagtttaaattagtttttaaacgtgggtcgttggttaagaggaatttttttatttacgatttttttttatatttagtttttattgtttagagtatgttagttttgtttgttttggtttttaggatttttttagggatttttaggttttaagttagggtgggtttgaattaaggtagttttagaatttatgttaatgtttttgttagtgggagattttggggagtatcgtgcgggatgtatggggttaggcgggggtatatagcgagcggttttagaagttttggtcgttcggagtgggggggtgtttagagtaagagacgggttaggaagttggagtgagtaaggaggttttagtttttggtgggagtaggtcgggtaaaaataaattaatttgagggtagtagttagcgagattattataggaggggtggtggggtcggaggggttttaggagtttaggagagggaggtattgttagaggtaaggtcggtagatgagagttagtgttggtaggattaatttgttatagtagttatggtttattttttttttttttttttatatatgtttttggggtttatggaatttattagtttattataaaggatattataaaggatataggggaagagatgtgtagggtaaggtatgggggagggacgtagagtttttatgtgttttttaggcgttttattttttaggagtttttatatgtttatttatttagaagttttcggaattttatttttttgagtgtttacggaggttttattacgaaggtatgattgatttaattattggtcgttgatgatttgtttaatttttagttttttttttttatttggaggttgcggggtggtgttgaattttgtgattttatttggttttttttgggaattattttgaagttgttagttggtttgttaattatgagtatttaaaaagatattattttggagattttaaggattttaggagttgtgtgttaggaaatggagatgaaaattaagtgtatattttataatatgatagttagttttttttaattttagttttattttttgtcgtgttgtcggttttagtttttcgcgttttagggtttttgaatatattgtcggttgtttgtagcgatcgtttttgtttgttgggtttgagtttggtttattttttttatttttttgcgtttagttcgaaggtgttttttcgaggtagtttttttgatttggttttacgaatcgtaggttttgttttgttattggttttttttgttatatttgttattttttgtgttttacgtttattgatgtggttttgtatttgtgtagttttatgagggtaaggattgtgtttggttttgttttttacgggattttagcgttaagtttatagggagtatttaatgttgaatgaatgaatgagtgatcggtaagggaggtttattttgttatgttgggggttaaaggttgttgggcggattatatgggtgaggttgggtggggagggaagtagagatgattttttggaagaaggggtaggaggcggggaggtgggtgtggggtgttgtataaggatggtaagtgtttttaggggtgataagttaatttagagtattaggtagtagaaaaaggttgatatttttacgttttatttttatttagggagaggttaggttttcgggaaagttagtttttcgttgttaggagagttttaagggaagttttattagttgttgagttggttatagtggaaatttatgtggtgggtgggaggggtttgaggtataggggtttgggtggtggttttaggatggagatttgtgtttagattatgaggggtggttttagggatgattatttttaaataggaagtagataaaggtatagatggtagaagcggaggtagagaatgggttgtaggggtttttttagagggagagtcgagtaaggggataggttggaaatatttagtttttatggtttgaagtatagatagttggttttatacgtaggtcgggtagttatattatttagaataaggggtatgttcgtagggtaggttttaggacgtttcgggttggttttgttattagtttagaaagacggtttaggttttttcggtagggagtacgtttagttaggttttgggtaggagttgagattttttggttggtttgagaggggatgatcgagtgtaggtttagttcgggatttttttattttttttcgttatttagcggaattagttgggcgtgagaaaagaagagaagtgaattaagagtttagagtatgaggttggattagtttttatattatatgtaaaaattaatttaatttgtattaaagatttaaatttaagagttaaaattataaaatttttagaagaaaatataggggaaaagttttttgacgttgtatttggtaatgattttttggatatggcgttaaaagtataggtaatagaagaataaatagataaagtggaacgttatagaagtttaaaatatttgtatattagtttgggtgcggtgatttacgtttgtaatttcggtattttgggaggtcgagacgggtggattatttgaggttaggagttcgagattaatttagttaatatagtgaaatttcgtttttattaaaaatataaaaattagttgggtgtggtggcgggtgtttgtaattttaattatttaggaggttgaggtaggaaaatcgttggaattagggaggcggaggttgtagtgagttaagattatgttattgtattttagtttgggtaatagagttagattttattttaaaaaaaaaaaaaaaaattgtatattaaagggtattaataacgtggggagaaggtaatttatggaatggtagtaaattataggttagatatgggattagtatttggatattaatttatagattttttaatatttagtaataataattatttaaattaaatataggtaaaggatttggatagatatttttgtaagaatatgtgtaaatgagtaataaatacgaaaagatgtttaatattattaattattggggaattgtaaattaaaattataaggagagattttttataattatgagttttgggtaggtaggaagacgtttggtggggagttgtcggttttatgttgtttttagaatttttgtaggggttaagttcgatttcgatattttattaggagtatagaaacgagtggaaaaggttaaaggttattttaaagggttagaggggtttagtaaggagtttgggatatggaattatgttgtgtatttagatatacggggataatagggggatgaaaggtggtttttaaaatttatatttattttagagtttatgaatatggtttatttggaaaaagggtttttgtagacgttatgaagttaaggattttgagatgggattattttgggttatttagtgggttttaaattcgagaaagattgttcgtatgagagatagatagggggagatttagggtatagaaggaggtttcgtgataacggaggtagaggtcgagtggtgtggttacgagttaaggaacgttaagggtttcgggagtcgttagaagttgttagaggcgagaagtaggttttttttcggagttttcggaaagaattaggtttgttgatgtcgtgatttcggatttttggtttttagaacggcgagagaagaaatgtttggtgttttgagttatttagtttgtggtatttggtgatggtagttttaggaaattattatagggattagagtttttacggggttgggtaggaagcgggtgtagagcgcgttaggttaggttttttatttcggagatggaaaagtagagttggagaggttgagatcggataggtatcgagcgtttaggggtaagaatttttaggggatggtagaggttatcggggatagtatagcgagggataggagggaggggtgagggttgaggtatcgttttttaggaggtttcggtttttcgtttattgatgatttaggaatttcgtaagaggagttgggttttattttgtgtcgtattgtattagatggattttggtggggatagacgtttagcgatagcgtggttaagttttttttaggatttcgggtttgtatttatgattatgtatagacggttattttttttgtttgtagttttttttcgtggtttgtttttagttttttagtttaatagagttttttagtggaaagttttttttttggagattttttttttgttgaaatataagtttttggaataagataaaattgtttaatttgtaaaagttataaagtcgttttagaataaaaaaaaagtttcgatttttggttggaaggagtggttttttatgttttagcggttagttattattttatgatttatgtcggttttgttgataaattttttagtatttttttaggggaaggttatagtttttagggagggcgggagagtatttaggttttcgtttataaattagatcggagttagatattgtcgagggagggataagagggtaggttttggggtttttaagttttttttggggttggtagattatcgtggatttattagggtaggattatttttttttataaattttttttgggtagttgtagggtagtttgagttggatacgttttatacgttagtttagtggggtatgaggtatttatagttacgtttggaagttagcgggtcggtatttgtcgggtaggtttttgttatataggtatagcgttttttttatggtttttttttaggttagagtatgtttggggattagagtagttttcgtagtggtttgtagtttgataacgcggcgtgagttatgttttgtagagaagaagagttttttagtgagggaagaggcgtttataaaatttaggatacgcgtagaaattcgtaggaggtgggggcgttgtttaggggtcgtgtcgtttttattttttattttgtagatgacggaattgcggtttagagttgttaagtggtttgtttaaggttatttagtagggataggaaggaagttatttttttagggattgtgcgggagtttagtgataattaaagattagcgttaaagtttgtttaggacgagaattttattaagggaaatagtttcgggattgtcgtgtttattcggaaggtagttagtttataattgagtttttaaaaatgtacgtttttttatatgaaaatatattcgaatgggattttgtagaaagtattttttattaaggtatagttcgaggggaggttttcgttttatttttggttgtgttgtttttagttaagggtagtagggattagagtggtttttggggtatagtattggttgtttttaaagagtgttttgtttagtttatgaaaagttcgtgttttgtgagtttgggagggtgttattatttttagttttttagggagtattatttttaaatttacgtttttttgtttagtttttagattttttgttggttatttatttgggtttcggttagattatttataaagtgaaggtcgaattcgaggtttttcgaggtttttgttagttaggcgggtggagtgacgtttttttggggttggtggtttaggaggtaggggatttattgtggtttgtttaggttgtttggtggggtggttatttcgaggacggttttattgtgtaagtttgacgaaggttttttttagcgttttttgttttgcggtttttgttgggcggagagtaggacgttgggttttatatttattcgttttagcgggtttgagttttcgagtttaaatagataagatgtagttttattgttatttaagttttttgtcgttttttttggtttttttttgaggttcgtttgttgtgttcgattgggtgtgtttagcggtataatatatattcgttttattagttttaacgtgataattaagatgtggttttgaggtcgggcgtcgtggtttacgtttgtaattttagtattttgggaggttgaggcgggcggattacgagattaggagatcgagattattttggttgatacggtgaaattttatttttattaaaaatataaaaaaatatggcgggcgtttatagttttagttgtttgggaggttgaggtaggagaatggtatgaattagggaggcggagtttgtagtgagttgagatcgcgttattgtattttagtttgggtaatagagttagatttcgttttaaagaaaaaaaaaaaaaaagatgtggttttgggagtagtggtggaggggattatacgttttagagaggagttatcgagatgggttttttttttttaggttttttagggattttttaatatatatatagtggtaattaatagattagggtttaaggtacgtaggggttgatatttttagcgatttttcgttttatggttcgtaggttattttagaatatttaaagtttggagtttggtttagttattttatgttttttagcgttgggtttagagggcggtatgagcggtagaaattgttattattgttaattatcgatgacggcgttggttacgtgagatggtagttacggtatcgtatgtgagtgaagggattaaggaggttgggtttgggagggagggtttggaaagttggggtgaattaaaggtaggggagttttttttttttttatttgtttgtttacgttttgatgggtttgtgtttgcggtaagggggttgttagcgtgaatggatatacgtatatatatgtatatatacgtgtatatatacgttaggtttttttgagcgtcgggagtttttttttttataattaattgttaggaaggtatagaaatgttattttaggtaggagatcgaggtagttttgaagatagattttggttggaagtaaaaaataaattatatagtggataaattaattattagttaggtttaagcgtcgtcgttttagattcgagttaggggggtaggttttttatatttttttaaggtttcggcgttaatagttttagtattgatagtggttatgatatgtaagaatggtatattggaaaatgaaagggaagtagttaggagagaggagagtcgagtttaaataaaagttagatttaggagagtttagtttttgagacggagtttattttacgagtttggaatcgttaaaaagaaaagaaatatttttgtgaaaaatgagtaaaagcgttttttgtatgtttatttttttaggtataaataaagtttcgagtttagggtagtggggggcggtcgatggggagggggttgtttgcgtatttgagattcggtttttttttatttttacggatatatttagtagcggcgggagtttcggcgtttcgtttagaggcggtttttttttttttattttcgtcgtttttttttttttagttttttttttttttttttttttttttaaaaatattttttgtttggtttaatttttttaatttgttgtaattacgaatgtattcgaattattatatttttatgtgttgattatatgtttgtgttttaaattgaagtagtattgtttttttaaaacgggaggaaaaagggagtaaaggagagaaatttaaaaataggaggtaggagagagggttcgaagtgggtttcgaggagttcggtagattatcgggtttgtttgcgagagttttagagtttcggtcgttcggtttggtcggtggttgtagaggtttcgagtgcggttttcggtagttttttttttttattttttttagttttcgtcgtttcgaggtttgttgtttttttttaatatttatttggagatgtttaatttagatttttggaaattaatttatagagttaaatttttgacgatttttaaagttttttattttttttgtttcgcgatgttacgatttttttgggtttaagggtttaaaaagtttagtttttgcgtgtttgtttcgtttttttttgttttgggttggttttagtttttttttattttgtattttaacgtggttgggtaggaggaacggtcgtgttttaggttagcgtgttgagaaaaggtttcggagtatttgtttaggaggaattttgagaagttattttttttcgttttattagtttgtagtgatagaggtagttgtcgttttcgtttaggtagagagggcgaacgggacggggattttttggaagatttttattatatacgtatgagttagtgagtttttagtcgttttttgggagggagcgagttttttttttcgggaattcggggttttattgggggattagtgttgttttttattgtttattcggggtttttagaggttgtttatttatttggggggtttttattagtatatggttagggtttatgttgaggttaagggtttagtagagtaggtgggggtttataatgtgggtttttggggtgggaattaggggtattttttttgtttttaagttttattttaagggtttatttaaattcgagatacggaggttggttttgttggtttaagtttgtttaaagagaatgtgtgtttgtgttaaggttgagaatttaggtaatttttttgaaaattttagattgttagtttttgttgagaaagggaggacgcgtggtcgtattacggaagtttttttgtttggtcgtatagggttggtataagatagttttgttttttagataaaatattttttagtttgtgttgttttttaaggtttttaataaatttataatatttgtatttttttatttcgatatatttcgtaggtttttgagtttataatttttgttttatagagttaggtgagttatttgtgattaggtgaggtttatgtatagttttcggttagatgatagagttaaaggttttgaagtgttattttaggttatagtttcgttcgttttttgtttgggataggattttaaatgtaatttttttggtagaaaggatatttttttggggggtggggaggattatttttagttttttgggagatattaagtaattatttttttttaaagagtttggaggatagttttataggtagttagatagtgagggaggtggggatagtattttagtcgaggtgggaggttggggaggaagggagggattatagttacgagagaaggttgaataatggttttagggatagtatgttttaatttttagatttgtaaatgggattttgtttggaataagagtttttgtatttgtgatttagttgtagattttgttgtggcgagagtattttggatggtttaggtggtttttaaaggtagtttcggtgtttatataagacgggggtagagggagatttgatatagatagggatggttaagtggagatggggttcggagagatttgtagatgttggtgttgaaggtaagggttatgtagttataagttaagggatatttatagttattagaggtttaaaggggtaggcgatgaaggtagtggtttttaatttttttggtatttgggatcggttttagggaagataatttttttatagattagggagtggggagatggttttgagatgatttaagtgtattatatttattattttattttattttattttattgagatagagtttcgttttgttatttaggttggagtatagtggtattattttagtttattgtaattttcgttatttgggtttaagtaatttttttgttttagttttttaagaagttgggattatagacgtttgttatcgtgttcggttaatttttgtatttttagtagaaacggggttttattatattggttaggttgattttgaatttttgatttcgtgattcgttagttttggttttttaaagtgttgggattataggtataagttattgtgtttggtttttattttttattttttgagatagagttttattttgggattataggtgtgagttattgtattcggttataagtacgttgtattgattgtgtattttatttttattattattataatatataatgagataattatataatttattataatgtagaattagttggagttttgagtttatttttttgtaattagacggttttatttggtggtgatgggagacggtgatagattattaggtattagatttttataagaagtacgtaatttagattttttatatgtgtcgtttataatacggtttatttttttataagaatttaatgttatggttgattagataggaggtagagtttgggtagtaatgcgagtaatggggagtgattgtaaatatagatgaagtttcgttcgtttgttagttatttattttttgttgtgtaggttagtttttaataggatatacggggttgggaatttttgttttagagtttttagagggttatgtttagtggatattttgattttagtttggtgattttgatttcggatgtgtggtttgtagagttgtgagaggatggttgggcgttgttgtgatttagttagtttgtggttattcgttatagtagttgtaggaaattgatgtagcgttatagacggagttagggtttagtttattggagttgttttttgttattttatttttttttaaaatattgtgttaagttaattattaataattattgatttcgatgggtaggaatcgtagaggttttttggtttgtttttttaattttttttttaattttgaaataatattttttgttggtttttttgattataaatgtaatatttttttttgtattgagtttagaaataagagaaaaagtaaaaagtagaaattttagttgggtaaggtggtacgtgtttgtaattttagtattttgggaggttgcggcggaaggattgtttgaagttaggagttcgaggttgttgtgagttataattgtattattgtattttggttgggtaaaaagagtgagattttgttttaaattaaaaaaaaaaaaaaagaagaggaagaaaatttattaattttattcgagattttttatacgaatttttgttgtggggtagggaagtttaggaaggttttacgaggttttgatttagtttggttggcggtgggaatttgggaatagtttcgagtgaggggtcgggttatgattgagtttatttatttagttattttttgtacgttgtgtatattatgggtttgacggttagggttggagtatttgttgagtatagttttgatttttagttttatttagtatggtttggtttgaggtttatttttttttcgtgtttgaaaatttaaatattttggtttaggcgggggattatttgaaatggaaaatttggtagtatcgattggttttgaagaggtaggagttagttatgagtcggttgggaggcgagtgtagaggtggtgaggtaaggttagtagagggtgggggaggcgagggttaattttttatcgcgtatggtgtaagtattaagggggtattttattaggttagtgtagatttaggtttttgcggtggatttttcgcggtttttttttttagaggaatattgaagaggtttttgtggttttgttttagatttagaggtatatttgtatattaaacgtattgagtaattttatagtgagggagtcgggtttggtttaatttatttttttttaaattggattaaaggttgttgttttaggaaggtagggtttttaggtttacggttttgggaaattttggttgtgttagtttatgagtttagtttttagttattttagtttgtttatattttggagtgggtattgttatttaaaagttttttttagatagtttttagggcggtatttttgttttttattttttatagatttttggttatttttttgcgatattagtattattggtttatagttttttttaattgtaaagtggggtttagcggtataggttgggtttggtagggcgggaaggaagagcgaaggttattttgtttttaatagtattggtcgggttttggaaaggtcggaatttatagataggaaggaagtgttatatttatttaatttgttttgcgttagttagggggtattttgtagaaagaagttaggtggtcgtggtcgggtgtagtggtttatgtttgtaattttagtattttgggaggtcgaggtaggtggattataaggttaggggttttagattagtttgattaatatggtgaaatttcgtttttattaaaaatataaaaattagttgggtatggtggcgtatgtttgtaattttagttatttagaaggttgaggtaggagaattgtttgaatttgggaggtggaggttgtagtgagtttagattacgttattgtattttagtttgggcgatagcgcgagattttattttaaaaaaaaaaaaaagaagttaggtggttattttttagtttttggtttggtttaggaattgttttttttttaagatgttattaaatgttttttttattaggaagttttttttggttgttttttttatttttgtttttgttttagaatacggttcggtttttacggataattttgatattagagtttaatagagatttttttttttatggaaatttatattttaaattgaatatgtgtgtaggataagtttttgtttttatgtgaaataaaagtgaaaggtgcggattatttgtttttttttatttttttttataataatttgggttttataggggtttagtaggagttaggtttagtttagtcgttttaggtgtattattttgggtattagcgtttttgtttttttttacgaagtatagttttattttttggtatttagtggggaggggatatatattaggtattttttagggtggattgtgttttttatattaggttaggaggttttggggttggtttagttatttagaaaagggagtaggcggtttaggtgatattgatgtgggtagtaggggttttcgggaaagggttttcgtaggatcggttttattttgttttaggagtatatattggggaagggtgttgcgcggaggtggagagaacgtatttttggttgaaagtatgttttttgatgttttgggttcggatttgttgttattttttatgtttttttatttaatatacgttttagtaaattttttatgttgatgagcgttaagttatagaggacgtataatttttcgttttaaaaagtgattttttttgttgggtgtggtggtttatatttgtaattttaatattttgggaggttaaagtgggaggattatttgaggttaagagtttaagattagtttgggtaatatagagaaattttatttttataaaaaaaaaaaaaaaaaaaaaaagtttaggtatagtggtttatgtttgtaattttagttatttgggaggttgaggtaggagaattatttgaatttgggaggtagagattgtagtgagttaagattatgttattgtattttagtttgggtaatagagtaagattttattttaaaaaaaaaaaaaatttttttttttgaaatagggttttattttttttgtttaggttggaggatagtgacgtgattataatttattgtagttttagtttttcgggtagttggaattatagggttgtattattacgtttagttaattttttgtatttttagttaagacggggtttcgttatgttgtttaggttggtttggagtatttgagtttaagtgatttttttatttcggttttaaaagtattgggattataggtatgggttattatgtttagtttgaaaatattttttttaagaattagttagttatggtggcgtataattgtagttttagttatttaggaggttaaggtaggaggattttttgagtttggtaggttgaggttgtagtgagttataattgtgttattgtattttagtttgggggatagagaaagattttgtttagaaagaaaaaagaaaaaaaaaagatttttttatttattttttgtttatttttagatttaattattgaagtttgtttttttgaattaaaaatgaaggagtttcgttttggatttttttttgttgattttgttattgtatttgttagtagagttagttaagattttttaggttggttttagtttggttcgtttatagttttttaagtaagacggatttttaggttgaggttagttgtatttttttttggaatttttttttattttttattgtgttttagattttggttgtttttaaataaatataatttagttatttttgtttttggggtcgttgtagggtttattggtgtaaatcgtttgggtaggtttgttgttttaggagtttttttaggttagcgtggaaggaaattaagataacggggagaagtagttcggttgggtttaattttatttttatatgttcgtgtttagttaattatttgggttgtagtttgataggagttggagttggcgttttatttttagagggggttttcgattgtttttgtagagcgagggaggtttgggggtgtagaggttaagggtttttgtagagtttgttttaggttttttgagtttaagtttttttgtagttaacggaagattttttcgagagcgggtgttttttattttgtttgtttagtaggtgtttagtaatcgtttattggataaataatgaatttgtggatttaacgtgaagatgatttaaattagcgtttttttatagaatttttcgtaatgatgttaatgttttgtatttgtcgtagttaatatggtagttatatgtggtagtgaacgtttgtaatgtggaagggttattaaggtaaagagtttcgtatttatgttataatttaaatttaaatagttataaatgtttagcgtgtgtttcgttatatagattttttttgttattttttttttttttttagagatattgtattcgttattaattttttattcgggaggtaaacggagaaatgttattttttagttaacgtaaaagaaggttaatatttgtattttaagttagttttttgggtaatttttttaagtattttttattaaggttagtttagtaatattttttgattgtttgttacgtattaggaaagtatttcgtcgtggttttggttcgaggttatggaggatatagaaataattaaggttaagttgatagaaggggtgtgataagatggtttaaagttattgagttagttaggaggtttaggagtatggaagttttgttttttagaggataagtggtaatttatttagggggggttcgagtatttagagttaggagcgtagaagtagggggttttaggttggaaagcggtattagggttaggttgggcggtagtacgaatttattttcgaggttttgggggcggaaattaagggttttatgagtaagaagattcggtttaggtttaatggaaatgatcgggtggagggattttattattcggtttttagtatatagggagggaagtggtaatcgttttttaaatgttggtcgtggaggggaaggagttatagtagggtaggggtggggaggatggtatttgttggtttaaggagggatgatggaggtttaattaagatatgatcgtgatcggggtagtttgtttaagggttagtatgtagagggcgagttgatgagattttggtagtttgttgagatttgggggtgttggggaggtagaggttaaggttaattttgagattttttgtttgtaaatttgggtgggtggtaaggttgatattagagaaatagaggaagagtgggtagttatgggtgagagaggaagtaatgaattaggggtgtttgtaagagtttaggggtaaggttttcgggtagttaagatgttggtggttttttttacgattagttttttttacgtggtatatttttgtttgtatggttgggtatggggtatttgttcgttcgatatattttgagtagttattttgtgtattgaggtaacgtggtacggtgttttggggaaatagcgaggaggtattgtataggttttatttttttggtattttttgttttttggggatggtggtagttaaataagtgatagttaattgttaggagagtttggttttgatttattaggtggagttaggtatttttgtcggaagaggtatgggaattagtataggatgaagggaggtagcgagtattagtttaggttttgtttttatagggttttttttttatatttatttgtgtaggcgttttttgtgagggtagagatatttgtagtgtttgagggagattttttgcgggcggggtcgtttatttatagcggttaggtgggaggtgtattagtgttttgtggttgttataatggattatagttgtggggtttgaaaaaatggaagcgggtttttttttatgttggaggttagaggtttaaaattaaggtgttagtaaggttatattttttagggaggttttggggtggggtggggggggggtttttttttgtttttttttagacgttttttggtttggggttgcgttattttattatttgtttttgtttttacgtggtttttttcggtgtgtttgtggtttttttgttttttttaaggatattagttgttggatttagggtttattttaatttagaatgattttattttaagatttttaattatttatatttgtaaagattttatttttaatttttaggttatattttgaggtttttggtggatatgagtttgtgggggatacggtttaatttaggatagaagggatgatgggggtattggggaaaaggttatatattttagaggtattggaagatggaagagtaggatttagcgatacgggatgttaggtagaggagttggttttaaggattttagtcggggtttgagggttagagggagggaagtttaggtattattgagatgaaatgtttcgtgtatcgtgggaaatagggtaaaagttcgttggacgtttagttagagaggcggttgtttgaggtatagaaaatgagcgaatatgggagagtttattagaaggttattcgggagggcgtggtggtaatatttagaagggttgagaagcgtatttttatagtttagttaaatttatttggggaaatatacgttttcggtagtattagtaatagagaagattttcggcgatgttattagtgggttacgggacgggtaaattttgtttttttatatagaggaatattcgttagttgttaaaataagtgaattaaggtttcgtggatttatacggataagtttttacgtcgttacgttgtgggtataggtagggtagttattgattttagtgaggtattaaggatgtgatgttgatgacggtatttaagaggagatagatttaggttgtttagttatacgatgttgatgatcgtatgtaagaggagattaggtcggatgcggtggtttatatttataattttagtattttgggaggttaaggtaggtggattatttgaggttaggggtatgagattagtttgattaatatggtgaaattttgtgtttattaaaaatataaaaaaaattagttagatatggtggcgggtgtttgtaattttggttattgaggaggttgaggtagaagaatcgtttgaatttaggaggtagaggttgtagtgagtcgagatggtgttattgtattttagtttgggcgatagagcgagattttattttaaaaaaaaaaaaaaggagatttaggttttttagatatattattgtttagtatagatgtgtttgttcggggttagattttaatttagaggggcgggtatcgtagtaggagtggggttaggatggagaaggttatttagggttgcggttatatttgtaatgttttattttttaagcgggatggtgagtatataggtgttttattattttattttttatatttttgttttgtagttttaagaattttattttttttttaaaaggaaagaaagtgtgtgagttgattaaagcgttgattatggtgttatttaagtttttgttagaaatgttatttttggtttagttttaaatataatttcgagaagagttttcgtttttttggggagggtaagagttttagatataggagattggttagatgtggatttatagagaagttgggttgggaggatgggatggtagatagtcgtttggggagtgttaaatggggaggtcggagatgttggggcgtttaggaatgaatttttgtttggattagggttttagtaaaagggaggtagggagaaagaaagaagttaagaagatgaggaaagggtgtttcgggttagagtttatagaggtttatagagggaggatttcgtgtgttagtaggtagttttacgtaaatttagattattagtttgtagttttgggatttagtaaattatgttttaggtttttaagttgagttgtgatcgtggttgttaagtgttgatagtatagaattagttagtttgagtagagggaagtaatcgtcgggggaggttgtgtttatgtagtttagggtgttaggtttttaagatgtaatttttataagaattgggggattttttttatttattttattagaagttggttaatgagagggaaggagatggagaggtagattagatgcggagtcggagaaaagttttttagaaatatagtagcggttgggttgtttagtggttagtgtttaatatgattgcgatgggcggagttttttttaattatagcgttgaattatgtagttgtttaggggtttttagttagagtattatttttttttttttatatatagttttattttgtattgtaaggggttttatatgtatttaatgtggatacggtattttttttatttttattttttgtaaaaagttattttttttattgtttaggtttggtggtgtatagtttacgggtattgtatttatttttggaaggtagatttaggaggcgtttgtgttgtttttatagaagtaagtttaggattagaagtaggttttgggtttagaattttgaggttttaggtgttagtgtggtttggaattgtttagttttatagttattagttatacgtagatataagtggaaatttatttaaaataaataaataattttatgtaagtaaatgagtgaataaagtaaacgtaaatatttatattttgagtgtgtaatagatttaggcggttaagcggttattatataggatggcggagtgtagatgtatagaatagatttattattatagaaggttttattagacggagttggtttagagtatggaggtggcggttttagatgggtatatgtttttgttttcgtaggcgttttgttttggtaggacggttgttttattttgttttgaaggtagttttggtttataggcgttttatttgtgtggatttgatttcgggttcgtgttttttggtaattttgttttttttagaatggttaatttatgaaggtatagtttttgtttgtttgttattatgatggtagttaggggtttggtatttagttggtttttagtatatatgtataggtgattacgttatttttgttttttttagagtttttcgttttttaggggaggtaagtttatttattgttgtgatttattattttttttaaatagaaaagttattagatgggtatttgttttagtttggtcgttggaagtgatagttaagaataacgtaggtttttagaaatagaggtattagtatggttatattggggttaggtaggggagattagggatatttagtggggagaagatgacgcgtagatttagttttggggggtaagggttggaggtagagttttgatttttttgttttatttttttgtttaggttgtatttagtgttggtagagtttttttaagtttataagttgtaattcgtgttttggacggttagttttagagttttgatgggtgtatttgttttttttttttattggttagtgtggaaaatttttaaatatatggaaaaagtataaggagtagtatagtgattattgttagaggtttatttatttttttttagataatatcggacgtatttgttttattttggagtattttttattttgtaaggttgtagggagtttatagatattgaattaatatcgagaggtttacggttaaagttatttgtttatggtatatttgtttttttagtattttaaattaaattatttagttttatttattttttgtttttttttttgtttcgtatatacgggtttgttttttgagtttgggggtggttgtttttgtttttataaggattatttttagtagggtagcgtcgataggtttggaagttatttgagtttaaagtcgttaaagattgcgtttttttgggaaatgggtaagtggttttatttatttagggaagttaggtggggaggtaggttttagattagaatgaagggattttagtataaatatatttatgagttgggtggggttagagcggagcgagttatttatttgggttattggagttattaagttttcggagtcggttattggaggttcgcgtgttttttaaagatagagataaagggtaaaggttatataaggttattggcgtttttttttcgggtggatgattaatattaggaatgttttcgtttttgtttttgttgtgagttttagagttagaaacggggtttatttggggatagaggttttatttttttaggtaattttggacgttggagggatgatagttattgttgtttggttgttggaggggttttgggttaaatttttatatatatttttttttaagttttattatttttgttttgtagataaggaatttgagtttttatagagtgttatttttttgtggttatatagtgaatgagagttgtatataggtgagtttacgtttattagattttaagttgggttgtatttaagcgtgtttttgttggacggagtttttttttttttttatgtttattcgttttatgaattagggtttttttatattagggtttataatttacgggtagttttgatttagttttttttatttttagggttgggtgtagtcgggttggatttggggatggagtgggataggttatttttattttttgttttaggagggaataaaaatagaattttagattaatgtagtttttcgcggtatgcgttttttttgtttatatataggttttggtttggggttgtttgttggagaggtttatggtaggtaagttttaattcgaggagatttgttgaggtgttaagttaagtaaattcgaaaggttgttaggaggagcggttttgggagtataggcggttattttattgttgtagagtacggtattttggggatgttttttgggtaatgttatatagttattttttagagagttttagggatatataattagtttagttttattaatagtgagataagggattaggtagatttagatatttttttgtatttgattattatgttggttgttggttaaagatgttagtttttttttggaattttttagaaaggtttttgtagtatttatttatttatttatttatttatttattttatttatttatttatttatttatttatttatggattttatttattttattatttttttatatatttatttatttatttatttaatttatttatttagttttttatttatttatttatttattaatttatttatttgtttatttaatttatttatttattaatttatttatttattatttatttatttatttatttatttatttatttttttatttatttatttatttttttttttatttattttataattttatttttaaattgtgattagatggaaatgggtgtagttagtttgtttttaaaggtttagagcggaggtagagtgaattgtttatttggttttcgtgtttagtagtttaggtttgtatatatgttttataattataggatattagatttagtaattggtagtagaatgagtatagtgtatttttcgcggaattagtattgatagggtatttatttttattaagtttgagtttttttggtgttggagggaatttttagatgggttttaattttagttgaatttattttttagggaaagtaatatcgtgagaaatgcgtgtgatataaggttttaaagagggtgtgggtcgtgatttttggagtaattagggaggttttatggaggagatgaggataaagttgagttttgaaggagggatcggaggacgttgagtagggatatttatttttgtttgcgagggtttgacggtaggttgtgagttgtattttagtttcgatttatttaatttataattttagtaggtaggtgttttcgttttattttatagaggaggaagcgaggtttagggttgggtaaattgtttaaggtcgtatagttgcggaatttatttttagtatttttagtttgttttagttatgttcgtgattttatttagtattttttttttggtgtttatttattttgtttattgttaagtaataaaaattttattaggaaaatttaggggtttttggttagtttttttagatagaaaggtagatttcggcgtagatttttaggaagtaaggatggaagggttagtatttgttttttagaaatgatagtttttttaagattaggagagatggtttagagtgtagtttcggtgggttgtttaggattaggaggggagaggagcggggaggaggatgaattttatttttaaggttgttgagtggtatatagtgagtttggattttttagttttagttgagtttatttttacgatggttatgagtattttttttatatattcgattggaagtcgtattgtatataacgtatacggggttattattttttgttttatatatttttacgtatatattattagtgtattattgggatattttgttgttcggggttgagagtgaattagaattttgtttataaatttagtatattttattgtggaaataatggggggtaaggaggggtcgtttagtaaagaataggatatacgtttttgaggatggagttatttttggttgagatatttttgtaggggatgtcggcgataaaggttgttttatttttttttttgggttagatggatattatttttgttttttgttttttagtattaggtaaaaggaaaatagaagaggttttatttaggttaaatattttagggttttttattcgtaggaaatatgttggtttattttttttaaatttagtatgggggtggagaaacggtggggaaaatagtatttgttttagattttttgggtggagtttttgttttatttatattgtttatttttttgattttttaaaatgggtatttggtgtttggtagtttttggtatagagaagacgtaaagtaaatcgtttataagaagggggcgagcgtagtttgagtattttttgtttttgaataaattgttaggtttagcgtagtcgttgtcgttattgttgtttttaggaagggatttttggttacgagcggttttagtttagttttttggatttaattatttaggtttgtgtttgagtttagtaaagaggtagttagaaaagtttttaagatatttaacgatttcgtggttttagttgagaagtgagttatttttatgtgattttaaaataaaatatatttagaaggagagaagataattgaaatttagttgtttggagttattttagatgaaagtatttgagtttttgggaggtaaaggaggtaggaaagtttggagttagatgattagaatttgaacgtagatttcgttaggtttttgttgtgggttttgggagatgatttttattttttgagttttagtttttttggggatagagatggtgtttatttataggttgtttcgagttaatgaggttatatggcgtaagtattagtatagtgtttggtataaaattaaaatttaataagtgatattattattattattattattattattatttttgagatggagttttgttttgttatttaggttggattgtagtggtacgattttagtttatcgtaattttcgttttttaagtagttgagattataggtatttgttattacgtttcggttaatttttgtatattcggtagagatagggttttattacgttggttaggttggtttcgaattgattttaggtgatttgtttgttttagttttttaaagtgttcggattataggcgttagttatcgttatttggttgtgatattattataatattaatattataatagttggttaggtatggtgatttacgtttgtaattttagtaatttgggaggttgacgtgggttagttattcgaggttagttcgagattagtttgattaatatagggaaattttatttttattaaaaatataaaaattagtcgggcgtggtggtattcgtttgtaattttagttattcgggaggttaaggtaggagaatcgtttgaatttaggagacggaggttgtagtgagtcgagattatattattgtattttagtttgggcgatagagtaagattttgttttaaaaaataataataataaataaataaaatatattttgacgagatatggtaaaagatagtagaaggtaggagttcggggatttattatgggtcggcgttttaagtagaaagaaatgtagtgtttataagttagagagtagatgtcgaagataggagacgagcggggttttttggttttggagaggaaagggtgagtttaggtagaaagagtaaatttagggcgttttgtgtagtgttttttttgtggaattagtttagggtattagtagtatagtttttttttagtagtggagattaggttaattgtttagtgttttttttgtttttttgttttaattttattaagtatagtttttttttgggtatagtagttttgtaggggtggatattgatttatgtatttaggagtttagaggtttttttttttttatttatttatttagagatggagtttttttttgtcgtttaggttggagtgtagtggtattaatttggtttattgtaatttttattttttaggtttaagtgatttttttgttttaattttttgcgtagttgggattataagtatgtattattacgttcggttaatttttgtatttttagtagagatggggttttattatgttggttaggttggtttcgaatttttgattttgtgatttttttattttggttttttaaagtgttgggattatagacgtgagttattacgttcggttaggggttttttttaatggattttttttaatgtatataatttggggaatttagatataagaaagatatagagtatgaaggttttttattggtttgtttatttttagaggtggggttttaggtggtttaggttggttttaaatttttggttttaagtaatttttttgttttggttttacgttgggattataggtataagttattacgtttagttatttttttttttatttgggttgttatgttagaatttggtaagttataagatggaaatgtttaaataggtatttagaatttgagtagatattatttgatgtattattgttgttattttaatgattgaaatgtatttattatattcgtttttttaaaggttattttagatttttatagattttatttgtgatgtaagatagttattttaaatttttttgtgggttcgaatagattagatttttgaatttttgggtagagtagggatggggttgttttagaggagggtgatatcgttatatttttgttttgtttttgtgttgataatgaatgaggtttggatagttttttttttattaaaagttatatttttttaaaaaggagttttttaggatgaggcgttatgataatttaattgtgtataaatatttatttttaataatgatagaagttatttatagaaaagaatttatttttggtcgggtacggtggtttaggtttgtaattttagtattttgagaggttaaggtaggtaaattatttgaggttcggagttcgagattagtttgattaatatggtgaaatttcgtttttaatgaaaatataaaattagtttgtatgtttgtaattttagttatttaggaagttgaggtagaagaagtatttgagttcgagaggcggaggttgtagtgagtcgagatcgtgttattgtattttagtttgggtgatagagcgaaatttttttttaaaatatatatatatatatatatatatatatatatatatatatatataaatttatttttatttttttttttgaaatttttgagagaggttaggtgtagtggtttatatttgtaattttagtagtttgggaggttgaggtgggaggatggtttgaggttaggagttggagattagtttgggtaatatagtaagattttatttttattaaaaaataataaaagtttaaaaagtttttgagatagtttttggggaaaggtgggttatggagatttttattttggttattcgtgtttttttcgtttgtttttttgtggtttttttttattttgagtttggggtgggggcggtttgagtttaggatgggggtggtttgagtttggggtgggagcggtttgagtttgggatagggcggtttgagttggggtgggggcgttttaagtttgggttgcgggtattttgagtttggggtggggatgttttgagtttggggtgggggtgttttgagtttgggttgagggtggtttgagtttgtgttgggggtggtttgagttgggatgggggcggtttgagttgggatgggggcggtttgagtttggggtgggggcgttttgagtttgggatgggggtattttgagtttgggatgggggcgttttgagttgggatgggggcgttttgagtttgggatgggggcggtttgagttgggatgggggcggtttgagtttggggtgggggcggtttgagtttggggtgggggcgtttaggatgtataggttttattttttttttttgaggtttagtttgtttataggagttgtgaagggttggattaaagttaaaggtttaaattttagatttatttttagatttagtggataattaaaatatttaagtttatttttaaaggaagttgagataaggagataatggttattttttttttttttttttttttgtttttggtttttgttatttggagttgtgttttgaagaggtatattgggtattaggtttttttggttttgtttttattttttgtttagatatagaataatttttttttatttttaaggttgatacgtggggttgtggattaaagttaatttatttatttatgaggggagtaatttttttgttttaggaatttgtttttataggagaataaatattgtagaaggtattgtttttagtggtggtgtacgtttgtaattttagttatttaggaggttgaggtagaagaattgttagaatttaggaggtggaggttgtagtgagttaatattatgttattgtattttaatttgggtgaaaagattaagattttgttttaaaataaaaaaagaatagtattttgtgttaaggttaggggttttagttattttttttgtgaagcggaaggggtattattagtttttgtgagaaggaaatagtttatttaattataaaatgttaattaaaggaggtagtatattggttttggtgcggtgtcgttggtttttgtttggggtaggaggagggttgggggagagttaaaagttaaagaaggtttatggaggtcgttttttttttggtgattagttttttttttgacggtaagttgttaatagtatttggtttttaggttggggaaggtgagattagtttatatttgtttagggttttgttttgtttgtatgggtagtaggcgtttattttgttagatggttttgtttattatagggtattagtgttagttaaggatttatagagtttttttgtaaaggtttattagtgggtattgggattttgggttttatttatatagggtttttatataaaatataggatgtttagttaaatttggattttagataaataattaataattttttgaagagataaggattttgttgttttatttaagttggagtttagtggtatgattatggtttattgtaattttgaatttttggatttaagtaattttttaattgtagttttttaaagtattgggattgtaggtatgagttattaaggttagtaaataatgaattatttttaggtataagtatattttaagtttgttgtgggatatgtttatattaaaaattaatttttgtttatttgaaatttaaattgaatttattgtcgggggagataatggagtgatggattgatagaggagtatagagatagtttttttaaatttttagttgattaaagtttggtttttagtttttttgggtttttagagatgtattaagggtggaagcgattaggagggagataaaaatattgaagtttgagtgttagtattgagtcgtgtggttttggataggattgttttttttttgagttttagttttatatgttataattggttaataatagttataaagtattcgaagttaatggttgggagtttgttttaggaggtaggtattattaggatgtagagagagtgaggagtttttaaagttagtttaggttaggtatagtagtttatgtttgtaattttagtattttgagaggttgaggcgagagaattatttgagtttagaagtttaaggttgtagtgagttgtaattgtatcgttgtattttaggttgaatgatagagtttttgtttttaaaataaaataaaataaaataaaataaaataataaagttagtttgtgtattggattgtatgttgttttaaagtatttaaagtgagagaggttaggaagtaatgagatgtagaaaggtagggggaggaggtttagaggtattagagaagatagttgatttttatttttatatatttttggggtattttgagttttatttatatatttaggtgagaatttttgtatttgtgaaagtaatttgaggtcgagagaattaataggaaatcgttttattttttatgtagggtttttttataaataaggttgagtcgtagtttattattgtagttgagttttttgtagtagttgcggtggggaaggttttttaggaggtttgagtaatttagaaatatttatagtatattttttagtttttttagaggtttttgttgagatgaaagtgttttggttcgtggttaaagagtttagtatattgggtagttatagtttttattatattgatttggttattaggtttttatgaatttagtgaggggagatgggttttttagggaagtttgttgatttttttatattgttgtaaatgtaaagtttggtgattttattatttttagtaattgtgatgtagtaataataagaatagttatgtttatcgtttattgaaggtatatgatgagttagatattgtgttggtatatgtgatttttggaggtaatatatttttttttaaggaggaaatgattgagttttggagggagggttttttatttggttttaggtttttttttgatttgcgttttttttttttttttcgtttgttttattgtagtttttttggtttttttgttgtttttggaatgtattaagtttgtttttagtttagtttttgtattgttggtttttttttgtttttttaattttaatttagttgttattatttttgtgattttttattatttattttaaagtagttattagttattttttatgtaattattttattttaatttttattatagtttttagttttattttgatagtttttagaattgatgaatttattgattttgtttttttttattgtatgtaaattttaagaaataagagtttttgtttgtttattgttgtgttttagtgtttgttatagtatttggtatgtagtaggtgtttaatgaatatatttttaaaagaatgaacgattggaaggagtttgaaagaacgatggtttgtgttaatagtttatttttaatttttttagacgggatggagattattattatgtaattacgatttttttgagtttgtgtggtggttgacggtaggtgttagtttggttggattaagggatggttggtaacgtatcgtttttgggtgtgtttgtgagggtgtttttggaggagatgggtatgtgagttggtgggttgagtggtaaagatttttttttaatatggatgatattattttattgttagataataaaaaggtagagaaaaggtgaatttttttttttttttggaggtgggatgttttttttttttgtttttggatttagaatttttagttttttagtagttttttaggtttttaaatttttggttttaaattaagagttatattaatagttttttagttttgaggtttgtagatttggattgagttacgatattggtttttttgggtttttagtttgcggacggttttttgtggtatattttggtttttataatggtatgagttaatttttttaataaatttttttttatttatttattatttatttttttaattgtttatttgtttatttatttatttatttattatttattttttatttatttatttattatttatttaattaatgtatttatgtttgtttgtttatcggttatttatatttatttattaattatttatttatttattatttatttgttatttatttagttatttatttatttatttatttattttttttttttttttgagatggagttttattttgtcgtttaggttggagtgtagtggcgtgattttagtttattgtaatttttattttttaggtttaagtgattttcgtgttttagtttttcgagtggttgggattatagatatgtattattacgtttagttaatttttttatttttagtagagatggggttttattttgttagttaggttggttttaaatttttggttttaagtgatttatcggttttagtttattaatgtgttggttattataggtaagagttattgaatttaatttattatttgtttgtttgtttgtttgtttgtttgtgtttatttgtttgtttggttatttattatttatttatttatttgtttgtttgtttgtttgtttgtttgtgtttgtttgtttttatttttttgtttgtttgtttatttagttatttgtttgtttgtttgtttgtgtttgtttgtttttttttttttttgttcgtttgtttgtttatttagttatttatttatttatttattttttattggttgtttttttggagagttttggttgatgtagacggtgttttggtaagtttaggttgttatttagattattgtggagggagtgatttaaataatagatatgtattttttagtttgagaggtttaaagtttcggattaaggtgtcgttagggttagttttcggcgaggtttttttttttggtttgtatttatttttttgttgtgtttttcgttattttttttttgtttataagtgaggggggaggagagatttttggtgtttttttttttttttataaggatattaattttattagattagggttttgttttatgattttatttaattttaattatttttttaaaagttttatttttaattatagttgtattgggagttagggttttaacgtaggaatttaaggggaagggtatagtttggtttataataaatgggaaattatgtttatgattaaattttttagaagatatggtttattagcgtcgttaatgattgtaagtaaaggttagagaggaaaggggttttcgtggggtggggggcggtgggggtagttggtgtcgggaataaggtttttttttttgtttaatagtagggaagtgaggtcggttgtagatgttatttggggtgggaagagaggggagtttttgtttgtatattttgtgtgggttttggtttgattttttttcgtgttttttattttttgtgtttttttttgtgtgggagaaacgtcgatttttgttggtttaggtgtttaggtttttaggtttgttggttttgggttgggtttaattaacgagaggtttgggaggaatttgggaggtggaagtaagggagggcgcgggagttttttattttttttgttttagatagtttttttagtaggagaggtggttttttgtgtagttttagtttttgttagagttttatttttgtttgggtttttagtaggtgattttggtttttggattttggttataggatttttttttttttatttttatttaggggtggtggtggtattttgttgttaatttttaggttatttttataatgttaagaattttttttttatttgtatggtttttttttaaggtattgagaagggttttaattatatgtttatagggttaaatattttttgtaaaatttataaaatggaaaatattttttttataattaattaacgttttcgtttatttttagttttgagtttttgttcgttatatttttttttgtgtgaggtggaaacggaggtttgttgttacgtgggggtttttgttaaggagaagttgaattggaaagatatttagtttggttttggtcgggttatatttatgtagtttttatttatttttatgtatagtttagttattgttcgttatttcggtgtggaaacggattttagtaatattcgttttatttatcgttttaattttatttatcgcgtagaattaaaaattataagatacgaatatattttgcggtgtttggcgtcggaaaaacgtgcgtagtggagagaagtaagatttgaaatgtacgggtttagaagtaaatttgtggaaaattatttttattattagaggtgaagttgtaagtaaaggatttagtttttttaatgtggagttaaaatagaaaagtttttttggttagaaatatatgtataaatgttttatatgtagttagaaattttttttatttttttattttttttttgatgggaattatatttaaaaaaaaagaaaaaaataggatttattagaatttttgtgtattttgaataaaataattgtagtagtattattaattttatgttgatcgttatttttgtatatattttaattattaaaaataaaaataaaatttgattaattaaggagatttattcgttttatttatttatttatttttgagatggagttttattttgttgtttaggttggagtgtaatggtacgattttggtttattgtaatttttgttttttgggtttaagttatttttttgttttagttttttaagtagttgggattataggcgtgcgttattatatttggttaattttttatgtttttggtagagatggggttttattatgttgattaggttggttttaaatttttgattttaagtgattcgtttattttaattttttatagtgttggaattataggcgtgagttattacgtttagtttatgtttttttttgttgttttttttttttttttgagatatggttttatttttttatttaggttggagtgtagtggtatgattacggtttattgtagtttcgattttttgggtttaagtaatttttttattttagttttttaagtaattgggattataggtgtatgttattatgttttgttagtttttgtatttttagtagagacggggtttcgttacgttgttcggatcggttttgaatttttggttttaagtgatttatttgttttggttttttaaagtgttgggattataggtacgagttattgtgtttagtttgattagttttttgttttcgaaatagaaaacgatattataaagttattatattgaagaagtaatgttaaaaatgtgggagaaatagaattttggagatatgattgatagttgattggtatttttttgtatgtagtgatgtttgtgatatttaatagttgtttataatttataatttgttgttatttatttttttattttaaatgaattattgtatttatatttttagagggttgtataagtttatattattttgattttttgttgattgtttttttgttttttgtttggtttttattttttttattatttgtgtaattagtttttcgtttttaagtttttttgttttaaatgtttaagtggattaggtattgtggttttcgtttgtaattttagtattttgggaggtttaggtaggaggattatataaatttaggagtataagattaatttgggtaatatagtaagattttgtttttatatatatataaaaaatataaaaattagtaaggcgtgatggtatatgtttgtagttttagtattttgggaggttgaggtaggaggattgtttgaggttgggagtttaggattagtttgggtaataaagtaagattttgtttttataaaaataaaagaaaaaattaggtaggtatatagtgtgtatttatagttcgagttatttgggaggttgagaagggaggatcgtttgagtttaggagtttaaggttgttatgagttgtgattatattattgtattttagtttgcgtgatagagtgagattttgttttgggaaaaataaataaataaataaataaataaataaataaataaatgtttaagcggtttttattttttggttagattttattatatattttatgaataaatcgtatgtatgagaaaggtgagtagatgaatagggtagggttagggggttaaggggaagattatagattacgtggagcgagattagtggttaaaaattgttaattatagttaggtttggtggtttatgaaggtaattttaacggtcgggtttggtggtttatgttcgtaattttagtattttgggaggtcgacgcgagtttattatttgaggttaagagttcgagattagttcggttaatgtagggaaatttcgtttttattaaaaatattaaaattggttaggtatggtggcgggcgtttgtagttttagttatttgggaggttgaagtaggagaattggttgaattcgggaggcggaggttgtagtgagttgggattttattattgtattttagtttgggcgatagagcgagattttattttaaaaaatttaaaaaaaaaaaaataaaaaattgtagattttaataaggaagagttataggacgatattttaggatgcgggaaaaggttacgttagttttggattttttttgattaatgggtattttagttattaaaggggtagatgcgttttatttaatttttatttagttattagagtataatatagggatgtgttatagatagagatggagattaataggtagaggggtgatggggaggaagattgaggtaagaggaataaaacggggattgtagagggtaggtggtaggagtttgagggttttagaagaaattgttgtataagtaatgagttagtagggtgagtgacggttaggagaggtggtttaagaaaataaagagatattttcgggggtatagatgcgttttgaggggtcgaggaagagatggggaaggggtggttttgtggattttcggtatgattgtcgtggtgaaaaggaattaaagatttcgataaggggatgattttttaaataaggaagttttgggttttcgtagggggattagtagattgagggtaaacggtattttgtttattaaagttttaataaaatgttaaggtaagaatatttgtttggttttgggggtaattttagaaatattagaaaagggatttattatgcgtaatttttttttaattatttggagaaatgtatggttatttaagatagagaaaggtagttaaagtaagtggaggttaggtatagtgatttacgtttgtatttttagcgttttgggaggttgaggtaggaggatcgtttgaggttggaaatttagtattagtttaggtaataataaaataagattttgtcgttataaaaataaaaataaaaattttttgagacggagttttattttttttgtttaggttggagtgtcgtggtacgattttagtttattgtaattttcgttttttagatttaagtaatttttttgttttagttttttgagtagttgggattataggtatgtgttattatgtttagttaattttgtagttttagtagagatagggtttttttatgttggttaggttggtttcgaattttcgatttttttggttttttaaagtgttaggattataggtatgagttatcgcgttcggttgttataaaaattttttaaaaattagttaggtatgttaggcgcggtggtttttatttgtaattttagtattttgggaggttaaggtaggtggattacgaggttaggagtttgagattagtttgattaatatggtgaaatttcgtttttattaaaaatataaaaattagttaggtgtggcggtatatgtttgtaatcgtagttatttaggaggttgaggtaggagaattgttttaatttaggagtcgggggttgtagtgagtcgagattgtattacggtattttagtttgggtaatagagtaagattttgttttaaaaaaaaaaaaaaaaaaaaaattagttaggtatgtagcgtatatttgtagttttagttatttaggaggttgagaagggaggattaattgaaattgggaggtcgagattgggaggttatgattacgttattgtattttaatttgggtaatatagtaagattttgtttaataataataataataaataatgtaagtgggtataagaatttatttatttatttatttatttatttatttatgagatagggttttattttgtcgtttaggttggagtgtattggcgtaatttcggtttattgtaagtttcgtttttcgggtttatgttatttttttgttttagtttttcgagtagttgggattataggcgttcgttattgtatttagttaattttttgtatttttagtagagacggggttttattatggtttcgattttttgattttgtgatttgttcgtttcggttttttaaagtgttgggattataggtgtgagttatcgttttcggttttaagaatttattttattttagtattttggaggttgaggcgagtggattacgaggttagaagattgagattattttggttaatatggtgaaatttcgtttttattaaaaaaatataaaaaattagtcgggcgtgggggcgggtgtttgtagttttagttatgcgggatgttgaggtaggagaatggtgtgaattcgggaggcggagtttgtagtgagcggagatcgcgttattgtattttagtttgggtaatagagcgagattttattttaaaaaaaaaaaaaaaagaatttattttaagatagtaagttttagggttgaagttagtttttatttagttttaggtttaaagttataagtatggttattgtaatatttttatttaggatattattttttaggggtttagatttatattattaaggaggagcgtttatattagtagttggggagagggtggttttttataagatgtaatgtttattttgaagagttattatagtgataattatgaaatttatgtttgagatttaattttaagtgaaaagaatagaatttaatatttattttatggggagtataaaattttgaaaatatacgttttttataattaaattaaattttatgttatgtttttgaggagataagtattgaatggaatatagaagaaatgttatagttaatgattgttgaagttttttttttaattttttgtttatgttgtttggtaataagtaatatagaaaattgataataaaaagtaaaagagaaagaaaagatatagtgtatagtttagattgttttttttaaaaaattaaataataataataaaaagtataggtcgggtgcggtggtttacgtttgtaattttagtattttgggaggttaaggcgggcggattatttgaggtcgggagttcgagattagtttgattaatatggggatatttcgtttgtattaaaaatataaaattagtcgggtatggtgacgtaggtttgtaattttagttatttgggaggttgaggtaagagaatcgtttgaattcgggaggtggaggttgtagtgagttgagatcgcgtttttgtattttagtttgggtaataagagcgaaattttattttaaaaaaaaaaaaaaaaaagtataaatgtaagttgggcgcggtagtttatgtttgtaattttagtattttgggaggtcggggtaggtggattatttgaggttaggagtttgaaattaattcggttaatatggcgaaattttatttttattaaaaatataaaaattagttaggtatggtggcgcgtgtttgtaattttagttatttaggaggttgaggtaggagaattgtttgaatttaggaggtagaggttgtagtgagttaagattgagttattatattttagtttgggtgatagagtgagatttcgttttaaaaattaaattaaattaaattaaataaaataaaaaaaagaagcggtataatataaagtttcggtagttaaagcgttaatttttagttattaggaaggttttgttatttaatgatttatcgttttagttaaggttagttatattttgggtttttgatgttggaggtaatatgatgttaatattggcgagaaatttattattttttttttttcgtttttcggtgtcggtttttgtgtgtatttgtagtttttttattatcggtgtttttatggtgtttacgttatcggtttattttttagtaataattcgatagttcgatatttttgtagattttgtggttatagagttaaagttttttgttattagtgggttttgtagataattttttaaatttttttgggttgagttagttaagtttttaataagttggaagatgataggggttggatgtaatttatttttaattggtttgggttatatggatattattttttttttgggatttgatttgggatggaaataggagttatagtttatgggaaggttgtgaaaggaagtttcggttttagggtgcggattaggttgatttgcggaataaggttttaggggcggtttattcgtttgttttgtttagttttttttggtaattatatttattcggggtttattttaaatttggtaggtaatgttgttgtttttattttagtcgttgttttaatacgtttcgtttggttaggataggtgtttaggtatggtatttagggatattttcggttttcggggtttaatttttggtttttaggtgtagcgttgggaaaagtagagggtttcggttatggcgtaggtttcgttataggttatttaagtagtttgggaggagtcggaaagagagtaatgtatttatttggatagagattgaagttatatttttattgagaaaagatgatatttttgtttggattttttttttgaaattttaggtcggggtggggtaggagttagcgagagagtttagcgttttaaaggggattttttggtttttcgtgttttttaatttagtatttttggggatttatatatttagggtagagtggttatttagggttttttttatttagatataaaggttattgaaggtttcgggttaatatcgttttgaggatgattagcgatttgagtttttgttagagatagtaggtagtttgggtttaagggtcgtttagtgatttgaagttgggattattttatattttttgcgttatttttgttttttgttttggaggtttttaggttgttaatagttatgttttggagaattaggttagattaggttgggaataaagtttagttgttatagagttgtcgagaggttattggtaagtagtgtttaggagtcgttttttttttgttagtaatagtttaatgtttttttttataggggttgtaaatgggtttatgtttagggtggggttagggagataaagtagagagaaattgggttgggagtagagagtgttatgttttattttggagatttaaggttaggttattttgtagagttggtgtttagagtttttagcgtataggagaggaggtaaatagaatttgatatttagtagcgttcggtagacgtttttggaatgaatgattaaatttatatggagagttgaaatgggttaggaattttagggagacgggtagtttatagtttagtagggtcgttttagtagagtaggttaatgttaggttttttggtaaatttttcggggtttaggtataattgttatattaggaaaggggtaggggtgattagtttatcggttacgggggtattttattgtttttatagaagttcggtatttataggtttgggtgatatacgatttttatgtttggtattacgatggttgtttattaagtttttttatttattaggattgattttttttggttagcgattttagattattatgatttggtagttgtcgttaggtttgtttggttaaggattttttcggagattgagttattttatatagtaaagtgagttatggggttatagcgttgtgtgttgtgtataagtttcgagggttttatttagggattggtatttattgatttttataaatttttggtaatcgtttagagttgggatgtttttaaggtaatagttttaataaatagaggcgtaggaatttagcgcgttatttttcgttttattttaaaggtttatatttttaggggtttggagtttttttttggagttttttttattttaaagttagttggatttgtttaggaattgttattattattttttggtcgggtttgtattgatgtgtattgaattttttttattaggtttattttaggtaaattttagagtttacgtaatattgtttgtggataaatattggggcggaaataggggttatttttaggttttagttatatggggttgttagggttgtttgggatggtaggagagtgttagaggagggtagtttaaggattaggtagggggtgggaagtgtttttttttatgggtttttaagtgagatgttttttgtaaatatttatttgggatttttaagtagagggttggtttttatgttatttggatttggattttagattattgtttttaagtggtaattttgggtttttttgtatttgttttggtttgagttggttatatttgtggggggtggttttaggaagaaggtggattgtcgtaaacgtaatgtttcgttgttaggtgtattgttttcggttattagaatttttttgggtaggtcggggagatttgacgggtaagtgtttgcggtttggcgtgagcgggtagggtaggtggtttttgtttgggtatgtttttttatttttgtaatagattagggagagggttggttttaggatttaggtttagttagttgttttataattgaggggtttcggcggaggatataagttagatagagttatagattaatcgtacgaggtggttttttttttttagtttaggttttttgaatgcgttagagtagataagtttggacgtgaggaggtaagaggtagcgagaataggcgcggagacggggttgggggagaagaggaagaaattttgtgtttgtgttttttttacgttcgtttgttatcgggttagttgattggggaagtgttttttgagggtgtaattttttgtttttttcgtaagttagttttcggggcgttgggtgagggtgtagttttgtttattacggcgagttagtatattgaattacggtagaagttgttttttgtgtgggtgtagtttttttttttgtttaggatttagaagttacgatagtatagagttttttaatcgtggttggtgtttttttaggaattttttgaaagttatagagaaattttagagtggttgggtacggtggtttatgtttgtgattttagtattttgggaggttgaggcgggtggattatttgaggttcggagttcgagattagtttggttagtatggtaaaattttatttttattaaaaaatataaaaattagttgggtacggtggtatatgtttgtaattttagttatttaggaggttgaggtatgagaattgtttgaatttgggaggtagaggttgtagtgaatcgagatcgtgttattgtattttagtttgggtaatagagtaagattttattttaaaaaaataaaaaataaaaaaagaatttttagagtaatttttaggtgttagtaggggtgtgacgtaattttagtttcgtttttgtggtttatcggtttcgggtaagtttttttgtcgttgttatttatagagagtttttaggggagtttgggaatgacggtaagttttatgtgatttagtatgtaaagggagttttaaaatttagaatttagagagttagggcgggtatagtgtagttggttttagtgttgaggggttgggggagagattttgtattatgttttgattatagtaagggaagattatggaggtttttggaacgttttagtaatggcgtaattttagttttttttatttttttgttaatgataattatgattatgatagtagttaataggttatagagtaggtattttttagtttttttaaatatgaattcgtttaatttttataataatatagtattgttttatttaataaatgaggtaggttgggcgtggtggtttatgtttgtaattatagtattttgggaggttaaggtaggtagattacgaggttaggagttcgagattagtttgattaatatggtgaaattttatttttagtaaaaatataaaaattagttgggcgtagtggtacgtttttataattttagttatttaggaggttgaggtaggagaattatttgaatttgggaggcggaggttgtagtaagttgagattatgttattgtattttagtttgggagatagagtgagatttcgttttaaaaataaataaataaataaaattaaaaaatattatatatataaaaaaataaatgaggtaaatgagatgtatgaggtgagaattttgtgttatagggagaggcgtagtttggtgagatttaattttaaggggttggcggttttgagtttttaagtgtaattattggattatattgtttgtagattattattatttttattttattggaaggtcgggtgaggtaatcgggaaagtttggagtagtagtggagttgttagagagaatttgtttttagtgtttttttggattttgtagttgttttgtgtgggtttttgttgtttttcgtattggaaaagatttttttatagatggggttttatgacgttatttaggttggagtgtcgtgtttatttttaggcgttgttatagggttgtagttttgaatttttggttttaagcgatttttttgttttagttttttgagtagttttttgggtttaagcgattttcgtgttttagttttttgagtagttttttgggtttaagcgattttcgtgttttagttttttgagtagttgggattttaagcgtatttggttaagtttttttttattttttattatttaagatttttttttttttaaggtttagtttaattttatttttatttaaaattttcggggtatttttgtagtatttggaggttgaattgtttaggagggaagggtgttaatgagttggtgtttcgtttttattttgattttcggtgagaatgtaagttttttgtaggtaaggattatattttattattatttttgtatttatttagatttggttatgtgtgtttagtatataaagtgttttcgatgattgtttatagatttacggtatttgagattgttttaatatatttttttaaaattttttttttttttagaggtttacgaatgtttaaattaggtttatcgggaataatattatggttatttcgtttattttgaagtttatatataggtttggaagtaataatttcgtatagtttagatgaaaaaataaagatttttttgttgtttttggattgttagagttttgggggatttttaatattttttgttgttttttttaattttatggtgtcgatggtttgttggggggttagtttgatttttgcgagtgttcgtattcggaaaagggttggtgttaagatagttttaggatatttagaatgagggtaagaggttatttttattattagttttttttagttttattttatataattgtaatatagtgatttagtatattttgggttattgttaagtagggagtaaattagaaatggtttgagttttttttttttttatttttagaggggtttgtttttttaggtaaatataaggaggtatcgaggttgttgtataagagttggtttttgtttattttataaattttatttttatttattgtaaaaggttttgtttttttttttaaaaaaaaaaaaaaaaaagaaatttagtgaggggtggggtaggtgtgtgtggaggagaggagaaaaggataagtgatggtttttttattttttagtaagtcgtaggtgtagagattttaagtttgttttagggttttttcggtatttgtgtaggagggttttcgtagaaaaaatttaggatttacgatttgggaggatttcggttatttttattgtttggatttattagtgggaggtaaagtgtaagaaattaagggtaaagggttttttttgggcgggttagagattttttggaaagggttatgtatcgcgcgatttttataataattttaagtatttggagtatgttggggaggaagtttcggtgttaaaattaagtatgtgttatttggaagttcgttttcgtttattagtatattaatttatttacgtttttgatagagttgtgtttcgggtgcgtagagggttattttgttcgtaataatcgggtgaaagttgaaattttaagttattgatttagaagggtattttcggggaagttttgagtaattttttttgagataaggtattttattatttattttggtttttaaatatggaaagttagaggaaatcgataatggtttaaaggtagggggatggtttcgatgatttttttatttttaattaaggtttatgattttgtttttttattaataaaaattaatttatggatttttggtaggtatttttttatttgaatgaattaaaggagggatattaaataaacggtttttagatttagaagaggagacgttatttataatttgaggattgaggaggataaaggattttgtttgtttggattttttggagaaaattataaaggaaaaaaaaaaggaaggaaaagataaataatgaagatttggattttttttaatttgtttttgtggtttcggtgtgtttatttgtgaaatggaattttagagtgttagagcgggagttttttatgaaatgaaagtttttgaatcggtttatggtgaggtttaagttaggtttttttcgtttatttaaggcgggttttgttagggtggagtgaggatgttagtcgcgggcggcgttttgagcgtaaaacgtgaattcgagtcgttaagtttgggcgttgttggacggttttatttggaggtcgtttcgtgttttattaagtagaggagaaatcgaagagaattcgaagaaaggatgttgcggtttggattattagttttagaggttgaatttaaggatatttttttatttagtttcgattttatttatttatatagacgtatagggatttaaagtattcggtcgatttggaaagttagcgatttttgcgagggtgtaaggggcgaggaagagggagcgttttttagggtagttttttcgatattcgagtaagggttggagatagcgtaggggacggtcggtttaggtcgaaagcggttcgatagcggttttgttttgggaggaattcgatttgtagtgtgttcgtcgcggggattcgtttagtttcgggggcgtttcgttattttcggtcgtaggtatttaggtgagtagcgttggtttcgggatatcgatttttttttatttcgggcgcgaagtttatttgagtaagatttttttatggtgttttcgtggtcgtcgtttttaggaaagtgtggcggcgaggtagcggggcgcgcgtttttagggcgttaattttgggtcggtagtaggaaggcgggaagagggggcggttcgtcgtttggagtgtatcgatcgggtttcgtttcggtttcgttttcgtttcgttttttttcggagatgcgtatagaatttcggtttagtcggttgtggtttcgtttttgattcgtttttttttcgtttcgtgaacgtgcgcgtcgagttttattttcgtttatttttgcgttgcgttgtatttggcggagcggggttggcgggcgtcgggtttgggagggggcgttttcgcgcggtagcgtagattagattagattaggttaggtcgggggtgggggtcgtttgcgtggttcgtcgcgttcgtagttttgtatttttagtttttcgcgttggcgttaatggttggtttcgggagtcgtcgtattttttagtttcgagttcgggcggggcgggttcggttaggtggaagcgggcggaggtgcgggcgtttcgggcggtttcgtcgggcgaggcggcggcgtcgggtatcgcggcggcgtcgggtatagtcgggggtcggagtcggggtgtcggtttagtgggtcggggtagggcgggataggatatttgttttgttatttttttggtaattaaaagggtagagtgcgtcgattgagttggagttttagtttttttatttgtaaatgggcgcgttggatagatgattatttgttttttttgcgttgggtatcgtgcgtagttcggtgtatcggtgtagcggggtagatatagggagtcgttttttataattcgggtaacg

SEQ ID NO: 6 - DNA, 1405 bp, Artificial Sequence
  chemically treated genomic DNA (Homo sapiens)
cgttattcgagttgtaaagggcggttttttgtgtttgtttcgttgtatcgatatatcgagttgcgtacggtgtttagcgtagggagaataaatgattatttgtttaacgcgtttatttataggtgaggaaattaaggttttaatttaatcgacgtattttgtttttttgattattagaaaagtagtaggataggtgttttgtttcgttttatttcggtttattaagtcggtatttcggtttcgattttcggttgtgttcggcgtcgtcgcggtgttcggcgtcgtcgtttcgttcggcggggtcgttcggagcgttcgtattttcgttcgtttttatttggtcgggttcgtttcgttcggattcgggattgggaagtgcggcgattttcggaattagttattggcgttagcgcggggagttgggggtgtagagttgcgggcgcggcgggttacgtaggcggtttttattttcggtttggtttggtttggtttggtttgcgttgtcgcgcgggggcgtttttttttaggttcggcgttcgttagtttcgtttcgttaggtgtagcgtagcgtaggggtgggcgggggtggggttcggcgcgtacgtttacggggcggggagggggcgggttaggggcgggattatagtcggttgggtcggggttttatgcgtattttcggggaggggcggggcgggggcggggtcggggcggggttcggtcggtgtattttagacggcgggtcgtttttttttttcgtttttttattatcggtttaggattagcgttttgggagcgcgcgtttcgttgtttcgtcgttatatttttttgggagcggcggttacggaggtattatgaagaagttttatttaggtgggtttcgcgttcggggtggggaggggtcggtgtttcgggattagcgttgtttatttgagtgtttgcggtcgggagtggcgaggcgttttcggagttgagcgagttttcgcggcgggtatattgtaggtcgagttttttttaggatagggtcgttgtcgggtcgttttcgatttgagtcgatcgttttttgcgttgtttttagtttttgttcgagtgtcggaggggttgttttgggggacgttttttttttttcgttttttgtattttcgtaggaatcgttgattttttaggtcggtcgggtgttttgggtttttgtgcgtttgtgtgggtgaatggggtcggggttaggtggaggggtgtttttgggtttagtttttagggttggtggtttaggtcgtagtatttttttttcggatttttttcggttttttttttatttagtggggtacgggacggtttttagatgggatcgtttagtagcgtttaaatttggcgattcgggtttacgttttgcgtttaggacgtcgttcgt

SEQ ID NO: 7 - DNA, 1405 bp, Artificial Sequence
  chemically treated genomic DNA (Homo sapiens)
gcgggcggcgttttgagcgtaaaacgtgaattcgagtcgttaagtttgggcgttgttggacggttttatttggaggtcgtttcgtgttttattaagtagaggagaaatcgaagagaattcgaagaaaggatgttgcggtttggattattagttttagaggttgaatttaaggatatttttttatttagtttcgattttatttatttatatagacgtatagggatttaaagtattcggtcgatttggaaagttagcgatttttgcgagggtgtaaggggcgaggaagagggagcgttttttagggtagttttttcgatattcgagtaagggttggagatagcgtaggggacggtcggtttaggtcgaaagcggttcgatagcggttttgttttgggaggaattcgatttgtagtgtgttcgtcgcggggattcgtttagtttcgggggcgtttcgttattttcggtcgtaggtatttaggtgagtagcgttggtttcgggatatcgatttttttttatttcgggcgcgaagtttatttgagtaagatttttttatggtgttttcgtggtcgtcgtttttaggaaagtgtggcggcgaggtagcggggcgcgcgtttttagggcgttaattttgggtcggtagtaggaaggcgggaagagggggcggttcgtcgtttggagtgtatcgatcgggtttcgtttcggtttcgttttcgtttcgttttttttcggagatgcgtatagaatttcggtttagtcggttgtggtttcgtttttgattcgtttttttttcgtttcgtgaacgtgcgcgtcgagttttattttcgtttatttttgcgttgcgttgtatttggcggagcggggttggcgggcgtcgggtttgggagggggcgttttcgcgcggtagcgtagattagattagattaggttaggtcgggggtgggggtcgtttgcgtggttcgtcgcgttcgtagttttgtatttttagtttttcgcgttggcgttaatggttggtttcgggagtcgtcgtattttttagtttcgagttcgggcggggcgggttcggttaggtggaagcgggcggaggtgcgggcgtttcgggcggtttcgtcgggcgaggcggcggcgtcgggtatcgcggcggcgtcgggtatagtcgggggtcggagtcggggtgtcggtttagtgggtcggggtagggcgggataggatatttgttttgttatttttttggtaattaaaagggtagagtgcgtcgattgagttggagttttagtttttttatttgtaaatgggcgcgttggatagatgattatttgttttttttgcgttgggtatcgtgcgtagttcggtgtatcggtgtagcggggtagatatagggagtcgttttttataattcgggtaacg

SEQ ID NO: 8 - DNA, 2365 bp, Artificial Sequence
  chemically treated genomic DNA (Homo sapiens)
gtggtcgtggtgggggtgttagttgtaggggtgttttcggtgggtgggagttggtggtttttcgttggtgttatgggattcgtatgttcgttttgcgtttttcggtttttgagtttataggtcgggattttgtttgttagtcgcgtgcgttgtcgtttaatttttgtaggcgtagagcgcgcggcggcggtgatagagaattttgtttggttgtttaaatatagttttttgtagaaggattttgcgttcggggaaggggaggaatttttttttttttgggcgttcgtttttttcgttatggttcggtttttatattcgtttatatttggtcgtagcggggcgttcggggggaggggttgaggtcgcgtttttcgtcgttttttgggcgcgggttaggcggggaggaggggggcgtttcggtcgtgtgtttaggattgttttttagcggttattcgggttttagttttttaggtttggttttgataggcgggcggagtagttagtgcgagatagggaggtcggtgcgggtgcgggaatttgattcgttcgggaggcgggggcggggcgggggcgtagcgcgcggggaggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttcggggtcgttaagttgtgtagttcgtgggtcgggagtatcgaacggatatagtttaggtcgtggtagggtttagagtgggatgttttatggtttttatttaggtttggggatatttttattcgttttttagaatcgggtcgtgggggatagaaggggtttgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgtcggtgttggggttttgcgttttgcgttcgcgggagtaaatatagtaggcgaaggggaagtttatataatggtttttagcgttttggggtagggtttttgaggggcgggtttgtttttgtcgggatttggagttttcgtttttcggagaggtttttaggttgatttgggtagagttttttggtgggtcgggagggggaaaggttgtgttgaaatgagtaaattgtttaggtgttaggttaagttgggaggtgattagtttgaggtttttttcgttttatggttagaattagggttgatatttgggtgttttgagtttagttgtttatacggtttatttggggttagttttatttgagtgggggaggcggggttttttgggggattagaattttggttggacgttaagtagagtgttagtggttgttttttagggttgggtttgaggagggtgtggggcggcgaagggacgggagggggttgtgatttagtggttattggcgttgtgtagagtgtgagttggaaatatcgtagttattttgttagtttagtggtgaaagtttttttttaggttttatttttttgtatttttgttttttagagggaggggaggtttgggtttgtagagttgggagggtttgttgttttcgttttttttttttataatatttttttatttggatatttttgggtatatgt

SEQ ID NO: 9 - DNA, 2365 bp, Artificial Sequence
  chemically treated genomic DNA (Homo sapiens)
gtatgtgtttaaagatgtttagatgaggaggtgttgtgggggaggggggcgggaatagtaagtttttttagttttgtagatttagattttttttttttttgggaagtagggatgtaaagggatagagtttgaaaaagggtttttattattaagttgataaagtaattacgatgtttttagtttatattttgtatagcgttagtggttattggattataattttttttcgttttttcgtcgttttatattttttttaggtttagttttgaagaatagttattggtattttgtttggcgtttagttaaagttttggttttttaggaggtttcgttttttttatttagatagggttgattttaggtgggtcgtgtgggtagttgggtttaggatatttagatgttagttttggttttggttatggagcggggaggattttaggttggttattttttagtttggtttgatatttggatagtttgtttattttaatatagtttttttttttttcggtttattagagggttttgtttaagttagtttaggagttttttcgaggggcgggggttttaggtttcggtagaggtaggttcgttttttagaagttttgttttagagcgttggagattattgtgtgagtttttttttcgtttgttgtatttattttcgcggacgtaggacgtagagttttagtatcggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggttttttttgttttttacggttcgattttgggaggcggatgaggatatttttaggtttggatgggggttatgggatattttattttagattttgttacgatttgggttgtgttcgttcggtgttttcggtttacgggttgtataatttggcggtttcgaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttttttcgcgcgttgcgttttcgtttcgttttcgtttttcgggcggattaggttttcgtattcgtatcggtttttttgtttcgtattggttgtttcgttcgtttgttaaggttaggtttggggggttggggttcgagtggtcgttgggggatagttttgggtatacgatcggagcgtttttttttttttcgtttggttcgcgtttaggggacggcgagagacgcggttttagttttttttttcgggcgtttcgttgcggttagatgtgggcggatgtggaggtcgggttatggcgaggagggcgggcgtttagaggggaagagattttttttttttttcgggcgtagggtttttttgtaggaggttgtatttgggtagttaaataaagttttttgttatcgtcgtcgcgcgttttgcgtttgtaagggttaaacggtagcgtacgcggttggtaggtaggatttcggtttgtgggtttaagagtcgaggggcgtagggcgaatatgcgagttttatggtattagcgagaggttattaatttttatttatcgagggtatttttgtagttaatatttttattacgattat

SEQ ID NO: 10 - DNA, 219909 bp, Artificial Sequence
  chemically treated genomic DNA (Homo sapiens)
tgttatttgagttgtaaagggtggttttttgtgtttgttttgttgtattgatatattgagttgtgtatggtgtttagtgtagggagaataaatgattatttgtttaatgtgtttatttataggtgaggaaattaaggttttaatttaattgatgtattttgtttttttgattattagaaaagtagtaggataggtgttttgttttgttttattttggtttattaagttggtattttggttttgatttttggttgtgtttggtgttgttgtggtgtttggtgttgttgttttgtttggtggggttgtttggagtgtttgtatttttgtttgtttttatttggttgggtttgttttgtttggatttgggattgggaagtgtggtgatttttggaattagttattggtgttagtgtggggagttgggggtgtagagttgtgggtgtggtgggttatgtaggtggtttttatttttggtttggtttggtttggtttggtttgtgttgttgtgtgggggtgtttttttttaggtttggtgtttgttagttttgttttgttaggtgtagtgtagtgtaggggtgggtgggggtggggtttggtgtgtatgtttatggggtggggagggggtgggttaggggtgggattatagttggttgggttggggttttatgtgtatttttggggaggggtggggtgggggtggggttggggtggggtttggttggtgtattttagatggtgggttgttttttttttttgtttttttattattggtttaggattagtgttttgggagtgtgtgttttgttgttttgttgttatatttttttgggagtggtggttatggaggtattatgaagaagttttatttaggtgggttttgtgtttggggtggggaggggttggtgttttgggattagtgttgtttatttgagtgtttgtggttgggagtggtgaggtgtttttggagttgagtgagtttttgtggtgggtatattgtaggttgagttttttttaggatagggttgttgttgggttgtttttgatttgagttgattgttttttgtgttgtttttagtttttgtttgagtgttggaggggttgttttgggggatgtttttttttttttgttttttgtatttttgtaggaattgttgattttttaggttggttgggtgttttgggtttttgtgtgtttgtgtgggtgaatggggttggggttaggtggaggggtgtttttgggtttagtttttagggttggtggtttaggttgtagtattttttttttggattttttttggttttttttttatttagtggggtatgggatggtttttagatgggattgtttagtagtgtttaaatttggtgatttgggtttatgttttgtgtttaggatgttgtttgtggttgatatttttattttattttagtagggtttgttttaagtaggtgaagggggtttgatttgggttttattatgagttggtttaggagtttttattttataagaggtttttgttttggtattttgaagttttattttatagatgggtatattgaggttataagggtaggttaagagaaatttagatttttattatttgtttttttttttttttttttttttttttgtggttttttttaaaggatttaggtaggtaggattttttgttttttttagtttttaaattataaatagtgtttttttttttaaatttagaaattgtttgtttaatgttttttttttaatttatttagatagaaaggtatttgttaaggatttatgaattaatttttattgataggagaatagaattatgggttttagttggaggtgaaggagttattggggttatttttttgtttttgggttattgttggttttttttggttttttatatttaggaattaaaatgagtgataaagtattttgttttaaagaggattatttagaatttttttgaaaatatttttttgggttagtagtttagaattttaatttttatttggttgttgtgaataagatggttttttatgtatttggagtatagttttgttaggagtgtgggtgggttggtgtgttggtgggtgggagtgggtttttaggtggtatatgtttggttttggtattggggttttttttttaatatgttttaaatatttgagattgttgtggggattgtgtggtgtatggttttttttaggggatttttagtttgtttagggagggttttttgtttttggttttttatattttattttttattggtgggtttagatagtgggggtgattggggtttttttaggttgtgggttttgggttttttttgtggagatttttttgtatagatgttggaagggttttgaggtaggtttggagtttttgtatttgtggtttattgggaggtggggagattattatttgtttttttttttttttttttatatatatttattttattttttattgggttttttttttttttttttttttaaaaaaaaggatagaattttttgtagtaggtggaagtagagtttgtggagtgagtaggaattaatttttgtatagtagttttggtgtttttttgtgtttatttaaaggggtaggtttttttgaggatgggggaagggagggtttagattatttttggtttgttttttgtttggtagtggtttaaggtgtgttgggttattgtgttgtagttgtatggagtgggattggagggggttgatggtgggggtggttttttgtttttattttgagtgttttggagttgttttggtattagtttttttttgggtatgggtatttgtaggagttaggttgattttttaataagttattgatattatgaaattaaggaaagtagtaaaagatgttaaaaattttttaaggttttgataatttaaggataataggaaggtttttatttttttatttagattgtgtgggattattgtttttagatttgtatgtgggttttagaataaatggaatgattataatgttgtttttggtagatttggtttgaatatttgtgagtttttgaaaaggagaaagattttagaaggatgtgttggggtaattttaagtattgtgggtttatagatagttattgaagatattttatgtgttgggtatatatggttaagtttgagtgggtatagaaatggtaatgagatatagtttttgtttgtagagaatttatatttttattgggagttaggatgagggtgagatattagtttattaatattttttttttttgagtagtttagtttttaaatattataggaatgttttggaggttttaggtggaggtgagattgagttgggttttgaggaaggagaagttttgagtagtggagaataaaaagggatttggttaggtgtgtttgaagttttagttatttaggaggttgagatatgaggattgtttgagtttaggaggttatttaggaggttgagatatgaggattgtttgagtttaggaggttatttaggaggttgagataggaggattgtttgaagttaggagtttaaggttgtagttttgtgatagtgtttggaaatagatatggtattttagtttgggtggtgttatgagattttatttgtaagaaggttttttttaatgtggaaggtagtaagggtttatatagggtagttgtaggatttagggggatattggggataggttttttttggtagttttattgttgttttaggtttttttgattgttttatttggttttttaatggggtggaggtagtggtagtttataggtagtgtggtttagtggttatatttgggggtttagagttgttagttttttgggattaaattttattaggttgtgtttttttttgtggtataaggtttttattttatgtattttatttgttttatttgtttttttgtgtgtgtggtgttttttaattttatttatttatttatttttgagatggagttttattttgttttttaggttggagtgtaatggtatgattttagtttattgtaatttttgttttttaggtttaagtgatttttttgttttagttttttgagtggttgggattgtaggaatgtgttattgtgtttagttaatttttatatttttattagagatggggttttattatgttggttaggttgattttgaatttttgattttgtgatttgtttgttttggttttttaaagtgttgtgattataggtatgagttattatgtttagtttgttttatttgttaaatgggatagtgttatgttgttgtaaaggttaaatgagtttatatttgaaaaagttgagaaatgtttgttttgtaatttgttagttgttgttatgattatgattgttattgataggaggatggagaaggttggggttatgttattgttaggatgttttagaagtttttatgatttttttttattgtggttagagtatggtgtagggttttttttttagttttttagtattggagttagttgtattgtatttgttttggttttttaggttttgagttttgggattttttttgtatattaggttatatggaatttgttgttatttttaggtttttttggaaattttttgtgggtggtagtggtaggaggatttatttgaggttgatgagttatagaagtgggattgaggttgtgttatatttttattggtatttgggaattattttggagattttttttttattttttatttttttgagatggagttttgttttgttgtttaggttggagtgtagtggtatgattttggtttattgtaatttttgttttttaggtttaagtaatttttatgttttagttttttgagtagttgggattataggtatgtgttattgtgtttagttaatttttgtattttttagtagagatggggttttattatattggttaggttggttttgaattttggattttaggtgatttatttgttttagttttttaaagtgttgggattataggtatgagttattgtgtttagttattttggagtttttttgtggtttttaggagatttttgaaggggtattagttatgattaaaaagttttatgttgttgtgatttttgagttttgggtagggagggaggttgtatttatataggaagtagtttttgttgtgatttagtgtgttggtttgttgtggtggatagggttgtatttttatttagtgttttgggagttgatttatgggaagggtaaggaattgtatttttagagaatatttttttagttagttaatttggtgataggtgagtgtgggaagggtataagtatagggtttttttttttttttttttagttttgtttttgtgtttgtttttgttgttttttgtttttttatgtttaagtttgtttgttttggtgtatttaggggatttggattggagagaaaaagttattttgtatggttagtttgtggttttgtttgatttgtgttttttgttgaggttttttagttgtgagatagttggttgagtttaagttttggggttagttttttttttagtttgttgtaaaggtagaaaggtatgtttaggtaggggttatttgttttgtttgtttatgttagattgtaggtatttgtttgttagatttttttggtttgtttagagggattttgatagttgagggtaatgtatttggtagtggagtattgtgtttgtgatagtttattttttttttggaattattttttataagtgtgattagtttaagttaggataggtatagggggatttaggattgttatttaggggtagtggtttggaatttaggtttaggtgatatgggagttaattttttgtttggagattttaggtgggtgtttgtagaggatattttatttgaggatttatggaaggggatattttttattttttatttggtttttgggttgtttttttttgatatttttttgttattttaggtagttttgatagttttatgtgattgggatttagaggtggtttttgtttttgttttagtgtttgtttataggtagtgttgtgtgggttttgaagtttgtttaagatggatttgataaggggagtttagtatatattagtgtaggtttggttagggggtgatgatggtagtttttgggtagatttagttggttttagggtaggaggggttttagagagaggttttaggtttttaggggtgtgaatttttggggtgaggtgggaagtgatgtgttgggtttttgtgtttttgtttgttggagttattattttggaaatattttagttttaggtggttgttagggatttatggggattagtgggtgttaatttttgggtgaagtttttggggtttgtatatagtatatagtgttgtggttttatggtttattttgttgtgtgaagtggtttagtttttgggagagtttttagttaggtaggtttgatggtaattgttaggttatggtgatttggaattgttgattaaagggagttagttttggtgggtggagggatttggtgggtagttattgtgatgttaggtatggggattgtgtgttatttaggtttgtgggtgttgagtttttgtgggagtagtgaagtgtttttgtggttgatgggttggttatttttgttttttttttgatgtgatagttgtgtttgggttttgggaaatttgttaggaggtttggtattggtttgttttattggagtggttttgttgagttgtgagttgtttgtttttttgaggtttttagtttattttaattttttatgtggatttggttatttattttagaagtgtttgttgggtgttgttgagtgttaggttttgtttgtttttttttttgtatgttggaggttttgggtattagttttgtagggtggtttggttttgggtttttagggtagagtatggtattttttgtttttagtttagtttttttttgttttatttttttgattttattttgggtatgggtttatttgtagtttttgtgaagggagatattgagttgttgttggtagaggaggggtggtttttgggtattgtttgttaatggttttttggtagttttgtgatagttgagttttgtttttagtttaatttgatttggttttttaaagtatgattgttggtagtttgaaaatttttaggataggaaataggagtggtgtagggaatgtaagatgattttagttttaagttattgggtggtttttagatttaggttgtttgttgtttttggtaggaatttaagttgttggttatttttagagtggtgttggtttggggtttttagtggtttttgtgtttgggtgagaggaattttggatggttattttgttttgagtgtgtgggtttttagaagtgttgggttagggggtatggagggttagaaagttttttttggagtgttggatttttttgttgatttttattttattttggtttggggttttagagaaggggtttaggtaggagtgttatttttttttaatggggatgtggttttagtttttgtttaggtgggtgtattgttttttttttggttttttttaggttgtttaaatgatttgtgatgaggtttgtgttatggttggggttttttgttttttttagtgttgtatttgggaattaggggttgggttttggaagttgaggatgtttttgaatgttatgtttgggtatttgttttggttaggtgaggtgtgttggggtagtggttgagatgggagtagtagtattgtttgttaggtttgagatgggttttgggtgagtgtggttattaggaagggttgggtagagtaggtgggtgggttgtttttggggttttgttttgtagattaatttgatttgtattttggggttggggtttttttttatagtttttttatgaattatggtttttgtttttattttaaattagattttagaagaggaataatgtttatgtaatttaagttagttggaagtgggttatatttaatttttgttattttttagtttgttaaggatttgattaatttaatttagagggatttggagggttgtttgtaaaatttattaataatagggaattttagttttgtagttatagggtttatagaggtgttgggttgttgggttattgttgggaggtgagttggtggtgtagatattatggaggtattggtagtggaagagttgtaagtgtatatagaggttggtattgaggggtggggaggaggaggtggtggattttttgttagtgttggtattatgttgtttttagtattagagatttaaggtgtggttgattttggttggggtgatgagttattggatagtagagtttttttggtagttgggggttaatgttttaattgttgggattttgtattatgttgttttttttttttgttttgtttggtttggtttggtttggtttttgagatggagttttattttgttatttaggttggagtgtggtggtttaattttggtttattgtaatttttgttttttgggtttaagtaatttttttgttttagttttttgaatagttgggattataggtatgtgttattatgtttggttaatttttgtatttttagtagagatggggttttgttatgttggttgggttggttttaaatttttgattttaggtgatttatttgttttggttttttaaagtgttgggattataggtatgagttattgtgtttagtttgtatttatgtttttttttttttttttttgagatggagttttgtttttgttgtttaggttggagtgtaaaggtgtgattttagtttattgtaatttttattttttgggtttaagtgatttttttgttttagttttttaagtagttgggattataggtttgtgttattatgtttggttaattttgtatttttagtatagatggggtgtttttatgttggttaggttggttttgaatttttgattttaggtgatttgtttgttttggttttttaaagtgttgggattataggtgtgagttattgtatttggtttatgttttttattattattatttaattttttaaggaaagtaatttaaattgtatattgtatttttttttttttttttgttttttgttgttagttttttgtattatttattgttaaataatatgaataggaaattgaaaggaaaattttaataattattggttgtagtattttttttgtgttttatttagtgtttgtttttttaggaatatgatatagggtttgatttaattatgaaaggtgtatatttttagagttttatattttttatagaatgaatgttgaattttgttttttttatttgaaattagattttaggtatggattttatgattattattataatggttttttagagtggatattgtattttgtagggaattattttttttttagttgttggtgtggatgtttttttttgatggtgtgggtttgggtttttgaagggtggtgttttgagtaaagatgttatagtagttatgtttatagttttgggtttggggttaggtggagattggttttaattttagagtttgttgttttaaaataaatttttttttttttttttttgagatggagttttgttttgttgtttaggttggagtgtagtggtgtgatttttgtttattgtaagttttgttttttgggtttatattatttttttgttttagtattttgtatagttgggattataggtatttgtttttatgtttggttaattttttgtatttttttagtagaggtggggttttattatgttagttaggatggttttaattttttgattttgtgatttatttgttttagtttttaaagtgttgggataaaataaatttttagggttgggagtggtggtttatatttgtaattttagtattttgagaggttgaggtgggtagattataaggttagaagattgagattatggtgaaattttgtttttattaaaaatataaaaaattagttgggtgtagtggtgggtgtttgtagttttagttatttgggaggttgaggtaggagaatggtatgaatttggaaggtggagtttgtagtgagttgagattgtgttagtgtattttagtttgggtgatagagtgagattttgttttataaataaataaataaataaataaataaataaatttttatatttatttgtattatttattattattattattaaatagggttttgttgtgttgtttaggttggagtgtagtggtgtgattatgattttttagttttgattttttagttttaattggttttttttttttagttttttgagtagttgggattataggtgtgtgttgtatgtttggttaattttttttttttttttttttttgagatagagttttattttgttgtttaggttggagtgttgtggtgtaattttggtttattgtaatttttggtttttggattaaagtaatttttttgttttagttttttgaatagttgtgattataggtatgtgttgttatatttggttaatttttgtatttttagtagggatggggttttattatgttggttaggttggttttaaatttttgattttgtgatttatttgttttggttttttaaagtgttgggattataggtgggagttattgtgtttggtatgtttggttaatttttaaaaaatttttgtagtagttgggtgtggtggtttatgtttgtaattttagtattttgggaggttaaggaggttgggagtttgagattagtttgattaatatggagaaattttgtttttattaaaattataaaattagttgggtatggtggtatatgtttgtaattttagttatttaggaggttgaggtaggagaattgtttgaatttaggaggtgggggttgtagtgagttgagattgtgttatggtattttagtttgggtaaagagagtgaaattttgttttaaaaaatttttgtttttgtttttgtagtgatagggttttgttttgttgttgtttaggttggtattgaatttttagttttaagtgatttttttgttttagttttttaaagtgttgggagtataggtgtgagttattgtgtttggtttttatttgttttggttgtttttttttgttttaggtaattatatatttttttaggtaattaagaaaagattgtgtatgatgagttttttttttggtatttttgggattgtttttaaaattagataagtgtttttattttgatattttattaagattttaatgaatagaatgttgtttgtttttagtttgttggtttttttgtgaaggtttagggtttttttgtttgaaaagttatttttttgttgaggtttttgatttttttttattatggtagttatgttgagggtttatagagttattttttttttattttttttttggttttttaagatgtatttgtatttttggagatgtttttttgtttttttgggttattttttttggttgttatttattttgttgatttattatttgtgtaatagttttttttggaatttttaggtttttgttatttattttttgtagtttttgttttgttttttttgttttagtttttttttttattatttttttatttgttggtttttatttttgtttatggtatatttttgtgttatattttgatggttggataaaggttgagtgaaatgtatttatttttttggtgattggggtgtttattaattagaagggatttaaggttggtgtagtttttttttgtattttggggtattgttttgtggtttttttttgttggagtttgtagttttttgtttttttttttttaaattttttgagatggagttttgttttgttgtttaggttggagtgtagtggtgagattttagtttattgtaatttttgttttttgggtttaattaatttttttgttttagttttttaagtagttgggattataggtgtttgttattatgtttggttaattttggtatttttagtagagatggggtttttttatattggttgggttggttttgaatttttgattttaggtgataggtttgtgttggttttttaaagtgttgagattatgggtatgagttattaggtttggttgttgagattatttttataagttattaggtttggttgtagttggtagtttttgattattggttttgttttatgtgatttgtgattttttttttggttttttggttttgttttgtttatttgtttattttttttatgtatgtggtttgtttatagggtatgtaatggggtttaattaggaaatggaaattgtttgagtatttatttatttatttatttatttatttatttatttattttttttaagataaggttttattttgttatgtaagttgaagtgtagtggtgtgattatagtttatggtagttttgaatttttgagtttaagtgattttttttttttagttttttaagtagtttggattataggtgtatattatatgtttgtttaatttttttttttatttttgtagagatagggttttgttttgttgtttaggttggttttgaatttttaattttaagtaatttttttgttttagttttttaaagtattggagttataggtatgtgttattatgttttgttaatttttgtattttttgtgtgtgtgtaaagataaggttttattatgttgtttaggttggttttgtatttttgggtttatgtgatttttttgtttgggttttttaaagtgttgggattataggtgggagttatagtgtttggtttatttgagtatttagaatagaaggatttaaaggtggggaattagttatatagatgatgggagaggtgaaggttagatagggaatagagaggtaattagtaggaaattaaagtggtgtgggtttatatagttttttaaaggtatggatgtaatgatttatttagaatgagaaaataaataatagtaaattataaattataagtagttgttaaatattataaatattattatatgtagaagagtattagttaattgttagttatatttttaaagttttattttttttatatttttggtattatttttttaatatgatgattttgtaatattgttttttattttgagaatagaaaattgattaggttggatatagtggtttgtgtttgtaattttagtattttgggaggttaaggtaggtggattatttgaggttaggagtttaagattggtttgggtagtgtggtgaaattttgtttttattaaaaatataaaaattagtagggtatggtggtatatatttgtagttttagttatttaggaggttgaggtgggaggattgtttgagtttaggaggttgaggttgtagtgagttgtgattatgttattgtattttagtttgggtgagagagtgagattatgttttaaaaaaaaaaaaaaaataataaaaaaaaatataggttgggtgtggtggtttatgtttgtaattttagtattgtgggaggttgagatgggtggattatttgaggttaggagtttgaaattagtttggttaatatggtgaaattttatttttattaaaaatataaaaaattagttaggtgtgatgatgtatgtttgtaattttagttatttgggaggttgaggtaggagaatggtttgaatttaggaggtagaggttgtagtgggttaagattgtgttattgtattttagtttgggtaatagagtgagattttattttaaaaataaataaataaataaagtgaatgaatttttttagttgattaaattttgtttttatttttggtagttgggatgtatataaaagtggtggttaatatggagttggtggtgttgttataattgttttgtttaagatatataggaattttggtaaattttgtttttttttttttttttaaatgtgatttttattaagaaagaagtaggaaaatgggggagatttttaattgtatatgaggtatttgtgtatgtatttttgattagagagatttttttgttttgattttatattgaaggaattgaattttttgtttataattttatttttggtgatgggagtaattttttatagatttgtttttggatttgtgtattttaaattttgtttttttttattgtgtatgtttttttggtgttaggtattgtaggatatgtttgtgttttgtgatttttgattttgtgtggtaggtggaattggaatggtgagtggagtgagtattgttggaatttgtttttatattgggatagtgagtagtaattgaattatatatggaaataaatgggaattatataaatataatttgattaaagttaaattaaatatttttttagtttaatttttttttagtaggagtttttatgtggtagtaagtttttgtttttattttatataagagaaaatgtgatgggtaggaatttaagattggaaatgaatggggatgttaattgattgtagggaaaatattttttattttgtaaattttataaaaaatgtttgattttgtggatatgtggttagggttttttttagtgttttgagagggaattatgtaggtagagggagggtttttagtattgtgggggtgatttggagattggtagtagggtgttattattatttttaggtggggatgagagggaggaagttttgtgattagagtttaggggttagagttatttgttgggagtttaaataaaggtgggattttggtaggagttggaattatatagaggattattttttttgttggagaagttgtttgaggtagaggaggtggagagtttttgtgtttttttttgtttttattttttaggttttttttaagttttttgttggttgaatttagtttaaagttagtaggtttggggatttggatatttgagttagtagaggttggtgttttttttatataaaggagggtataagaagtgggaggtatggagggggattaggttaggatttatataggatgtgtaaataggagtttttttttttttttattttaaatggtatttgtagttggttttatttttttgttgttagataggaagaggaattttgtttttggtattagttgtttttattgttttttattttatggaggttttttttttttttggtttttgtttgtaattattggtgatgttgatggattatattttttggggagtttggttatgaatatggttttttatttgttgtggattaaattgtgtttttttttttgaatttttgtgttgaagttttaatttttaatgtagttgtaattgaagatagggtttttagggaggtaattaaggttaaatgaagttatagggtaggattttaatttaataggattgatgtttttataagaagagggagagatattagagattttttttttttttttatttgtaaatagaggaaaaatgatggaggatatagtagggaggtgggtataagttaggaagaggggttttgttgggaattaattttgatggtattttgatttgggattttgggttttttaaattgagaaatatatgtttgttgtttaagttattttttttatagtaatttggatggtagtttgagtttattaaggtattgtttgtattagttagggttttttagggagatagttaataggagatggatggatggatggatggttagatagatagataagtggatagagagagagagagataggtagatatagatagataggtagataaatggttagatagataagtagatagagagatagagatagatagatataaataggtaaatagataggtagataaatggatagatagatgatagatagttaggtaggtagatagatatagataggtagatagatagatagatagatgataggttgggtttagtgatttttatttgtaataattagtatattggtaggttgaggttggtggattatttgaggttaggagtttgagattagtttggttaatagggtgaaattttatttttattaaaaatagaaaaattagttgggtgtggtggtgtatgtttgtaattttagttatttgggaggttgaggtatgagaattatttgaatttgggaggtggaggttgtagtgagttgagattatgttattgtattttagtttaggtgataaagtgagattttattttaaaaagaaaaaaaagatagatagatgaatggatagatagttagatagatgatagatggatgataggtagatagataattgataaatagatataaatgattgatggataggtagatatagatatattgattaggtagatgatagatggatagatagaagatagatggtggatgggtgggtagataggtagatagatagttagaaagatagatgatagatagataggaaggaatttattaggggaattggtttatattattgtggaggttaagatgtattatagaaggttgtttgtaagttggaggtttaggaaagttagtattgtggtttagtttaagtttgtaggttttaggattgggaagttgttgatgtaatttttagtttaaggttaaaggtttgagagtttggggaattgttggagaattgggagttttaagtttaagggtaggagaggaaggtattttatttttaggagaaagagggaatttattttttttttgtttttttgttgtttggtaatggaatggtgttatttatattgagggaggatttttattatttagtttattaatttatatgtttattttttttagaaatatttttatagatatatttagaagtgatgtgttattagttattttttaatttagttaaattgatatttgttgttagttattatataggtttagaagaattgtggttgtatggtgatggtttttattttgtttaaagaagttgaagatgaattgttggtataagttattgtttttttaggttttttttagttgtttatttttttaaaaatgtatttattgagtatttgttgtatgttaggtgttgtgataagtattggggtatagtagtgagtaaataaggatttttgttttttggagtttatatgtagtagaaggaaatagaattaatgaatttattagttttagaaattattaaaataggattaagagttgtggtgagaattaagataaggtgattgtatagaaagtgattgatggttgttttggaatgagtggtgaggggttatagagatgatgatagttgagttgagattgggaagataggaaggagttagtagtgtaaggattaggttggaagtaagtttggtgtattttaggaatagtaaggaggttagaggggttgtagtagagtaggtgaggaggaggagggagatgtaggttaaagaggagtttggggttagatggaggattttttttttaaagtttagttattttttttttaaaggagaatgtgttatttttaaaagttatatatgttagtatagtgtttggtttattatatgtttttagtaggtggtgagtatggttgtttttgttattattatattataattattaggaataatggagttattaggttttgtatttatagtaatgtgagggagttagtaagtttttttggggaatttatttttttttattaagtttataagagtttgataattaggttaatgtagtgagagttatagttgtttagtgtattggattttttagttatgggttaggatatttttattttagtagaaatttttaaggggattggggagtgtgttgtggatgtttttgggttatttagattttttggggagttttttttattgtagttgttgtagggagtttagttgtagtgatgaattgtggtttagttttgtttatgggaaaattttatatgggagatgggatggttttttgttggtttttttggttttaggttgtttttataagtgtagggatttttatttgggtgtgtgaatggggtttaggatgttttaagggtatgtggagatgggggttagttgttttttttgatgtttttgaattttttttttttgtttttttgtattttattgttttttggttttttttattttgggtgttttggaataatatgtaatttaatatataggttgattttattattttgttttgttttattttattttattttggaaataaaggttttgttatttagtttggagtgtagtggtgtaattgtaatttattgtagttttgaatttttgggtttaagtgatttttttgttttagttttttaaagtgttgggattataggtatgagttgttgtgtttggtttaggttggttttaaaagttttttattttttttgtattttgatgatatttattttttggagtaggtttttagttattggttttggatattttgtagttattattggttagttgtggtatgtgaagttgaggtttaggagaagggtagttttgtttaaggttatatggtttagtgttaatatttagattttagtgtttttattttttttttggttgtttttatttttagtgtatttttggaggtttaagggagttaaaggttaggttttggttagttaagaatttaaaaaagttgtttttgtgtttttttgttaatttattattttattattttttttgataatgaatttagtttgaattttagataaataaggattaatttttagtataagtatattttataatagatttgggatatatttatgtttaaaaatgatttattgtttgttggttttagtagtttatgtttataattttagtgttttgggaggttatagttggagaattgtttgagtttaggagtttaaggttatagtgagttatgattatgttattgagttttagtttgggtgaagtagtaagatttttatttttttaaaaaattgttgattgtttatttgaaatttaggtttaattgagtattttgtattttatatgagaattttatataggtgagatttagagttttaatgtttattggtaagtttttgtagggaggttttgtgggtttttggttggtattgatgttttgtgatgagtagggttatttggtaaggtggatgtttgttgtttatgtaggtagagtaaggttttgggtaggtatgagttgattttattttttttagtttgggagttagatattgttggtagtttgttgttaagagaggggttggttattaagagaggggtggtttttatgggttttttttggtttttggtttttttttagttttttttttattttaaatagaggttaatggtattgtattagaattagtgtgttgttttttttggttggtattttgtagttgggtagattgttttttttttataggagttggtggtgttttttttgttttatagggaggatggttgagatttttgattttgatatagggtgttgttttttttttgttttgagatagagttttggtttttttatttaggttggagtgtagtggtatgatgttggtttattgtagtttttattttttgggttttagtaatttttttgttttagttttttgagtagttgagattataggtgtgtattattattgagaataatgttttttatagtgtttatttttttgtaggagtaagtttttaaggtaaggaggttgttttttttatggatgaataaattgattttgatttatagttttatgtgttagttttgagggtggggaaaggttgttttgtgtttaggtagggggtgggggtaaggttaggagggtttggtgtttagtgtatttttttaggatataattttaggtagtagaggttaaggatagaggggaggagaagagggaggtggttattatttttttattttagttttttttggagataagtttgagtattttagttgtttattaagtttggagataagtttggaatttaaatttttgattttgatttagttttttatagtttttgtgagtaaattgagttttagaaaaagggagtgaagtttgtgtattttggatgtttttattttaggtttaaattgtttttattttaggtttaaattgtttttattttagtttaaattgtttttattttaggtttaaagtgtttttattttagtttaaagtgtttttattttaggtttaaagtgtttttattttaggtttaaagtgtttttattttaggtttaaattgtttttattttagtttaaattgtttttattttagtttaaattatttttaatataggtttaaattatttttaatttaggtttaaagtatttttattttaggtttaaagtatttttattttaggtttaaagtgtttgtaatttaggtttaaagtgtttttattttagtttaaattgttttattttaggtttaaattgtttttattttaggtttaaattatttttattttaggtttaaattgtttttattttaggtttaaagtgggaaggagttatagggaaataaatgggggaggtatggatgattaggatgagggtttttatgatttatttttttttaggggttattttaagagttttttaaatttttattattttttaatagagatggggttttgttgtgttgtttaggttgatttttaatttttagttttaagttatttttttattttagttttttaaattgttgaggttataggtgtgagttattgtatttggttttttttaggagttttaagaaaaaaaatgggaatagatttgtgtgtgtgtgtgtgtgtgtgtgtgtgtgtgtgtgtgtgtgtgttttgagaaagagttttgttttgttatttaggttggagtgtaatggtatgattttggtttattgtaatttttgttttttgggtttaagtgttttttttgttttagttttttgagtagttgggattataaatatgtaggttgattttgtatttttattagagatggggttttattatgttggttaggttgattttgaattttggattttagatgatttgtttgttttggttttttaaagtgttgggattataggtttgagttattgtgtttggttaggaatagatttttttttgtagatgatttttgttattattgaaaatggatgtttatgtataattgaattgttataatgttttattttaaaaagtttttttttgagaaaatgtgatttttgatagaggagagattgtttaggttttatttattgttagtataaaggtagagtaggggtgtggtggtgttatttttttttgagatagttttatttttgttttgtttaggggtttagaagtttggtttatttgagtttatagaggggtttggagtggttgttttatattataggtggggtttgtaaggatttgaaatgatttttgagaaggtgggtgtggtgggtgtattttaattattaaagtaataataatgatatattaaatagtgtttgtttagattttgagtgtttgtttaaatatttttattttgtgatttgttagattttagtataataatttaggtaaaagaaaaaatagttgggtgtggtggtttgtgtttgtaattttagtgtgaggttaaggtaggaggattgtttgagattaggagtttgagattagtttgggttatttgagattttatttttgaaaataaataaattaataaaagatttttatgttttatgttttttttatatttaggttttttaaattatatgtattggggaaagtttattaagagaagtttttggttgggtgtggtggtttatgtttgtaattttagtattttgggaggttaaggtgggaggattataaggttaggagtttgagattagtttggttaatatggtgaaattttatttttattaaaaatataaaaattagttgggtgtggtagtgtatgtttgtaattttagttatgtaggaggttgaggtaggagaattatttgaatttgggaggtagaggttgtagtgagttaagttggtgttattgtattttagtttgggtgatagaaaaagattttatttttaaataaataaataaagggagagaagtttttgggtttttagatatatgggttagtgtttatttttgtaaagttgttgtgtttaaagaggggttgtatttggtggaattggggtaaaagagtagggagggtattgggtagttgatttggtttttattattggaaaggggttgtgttgttggtgttttgagttggttttataaggaagatattgtatagggtgttttaagtttgttttttttgtttaggtttatttttttttttttaggattagggagttttgtttgttttttgtttttggtatttgttttttggtttgtgagtattgtatttttttttgtttggaatgttggtttatggtgggtttttggatttttgttttttgttgttttttgttatattttgttaaagtgtgttttatttatttattgttattattttttgaaatagagttttgttttgttgtttaggttggagtgtaatggtgtgattttggtttattgtaatttttgttttttgggtttaagtgatttttttgttttggttttttgagtagttgggattataggtgaatgttattatgtttggttaatttttgtatttttagtagagatggggtttttttatgttggttaggttggttttgaattgattttgggtgattggtttatgttagttttttaaattgttgggattataggtgtgagttattatgtttggttaattattataatattgatattataataatattatagttagataatggtgattaatgtttgtaatttgaatattttgggaggttgaggtaggtagattatttgaggttagtttgagattagtttggttaatgtggtgaaattttgtttttattgaatatataaaaattagttggagtgtgatggtaggtgtttgtaattttagttatttgggaggtggaggttgtggtgaattgagattgtgttattgtagtttaatttgggtgatagagtaagattttattttaaaagtagtaataataataataataataataatattatttattgagttttaattttgtgttaggtattgtgttagtatttgtgttatgtgattttattgatttggaataatttatgagtaagtattatttttgtttttaaggaagttgagatttaggaaatggaagttattttttagggtttatagtaagggtttggtgaggtttgtgtttaaattttgattatttgattttaggtttttttgttttttttgttttttaaaaatttaaatatttttatttgggatgattttagatagttagattttaattgttttttttttttttgagtatgttttattttaaaattatataaagataatttattttttaattggagttatggaattgttagatgttttggagatttttttagttatttttttgttggatttagatataggtttgaataattaggtttaaggagttgaattggagttgtttgtggttagaggtttttttttgggaatagtagtggtggtagtggttgtgttgagtttggtaatttgtttaagagtaggggatgtttaggttgtgtttgttttttttttatgaatggtttgttttgtgttttttttgtgttaagggttgttaggtattagatgtttattttaggaaattagaaaaataaatagtgtaaataaaataaaaattttatttaagaaatttgagatagatgttgttttttttattgtttttttatttttatgttgggtttggagagagtgggttagtatgttttttatggataagaggttttggggtatttaatttggatggaattttttttattttttttttgtttggtgttagggggtagaaggtaggggtggtgtttatttggtttagggaggaggatagggtagtttttgttgttggtattttttgtagagatgttttagttagaagtgattttatttttaggaatgtgtgttttgttttttgttgggtggtttttttttattttttattgtttttatagtggggtgtgttagatttatgggtagagttttggtttatttttagttttggatagtagaatgttttagtagtgtattgatggtgtgtgtgtggggatgtgtggaataggggatagtgattttgtgtgtgttatatgtagtgtggtttttagttgggtgtgtgaagggggtgtttatggttattgtggaagtgagtttagttggggttggagggtttaggtttattgtatgttatttagtagttttgggagtggggtttatttttttttttgtttttttttttttttggttttgggtagtttattggagttgtattttgggttattttttttggttttaaggaggttgttatttttgggaggtagatgttggtttttttatttttgttttttggagatttgtgttgaggtttgtttttttgtttggagggattggttaggaatttttgggtttttttggtggggtttttgttgtttagtagtgagtagagtgagtgggtattaagaggaggatgttgggtgaggttatggatatggttggggtaggttgggggtgttggaggtgaattttgtagttgtgtgattttgggtagtttgtttagttttgggttttgtttttttttttatgaaatggggtgggagtatttgtttgttggggttgtgggttgggtgaattggagttaaggtatagtttatagtttgttgttagatttttgtaagtagaagtgggtgtttttgtttagtgttttttggttttttttttaaggtttagttttgtttttattttttttatgaagtttttttggttattttaggagttatgatttatattttttttggagttttgtgttatatgtattttttatggtgttgttttttttggaggatgggtttaattaaaattggggtttatttgggggttttttttagtattagagaagtttaggtttagtagagatgggtattttgttaatattagttttgtgaaggatatattgtgtttattttgttgttagttgttgagtttggtgttttgtagttatggaatatgtgtataggtttgggttgttggatatgaaggttagatgggtagtttattttgtttttgttttgagtttttagaaataagttggttgtatttatttttatttggttatagtttaggagtggggttgtggaatggatggaaggaaggatgagtgggtgggtgggggggtgggtgggtgggtggatggatggatggatgatgggtggatgggttgatggatgggtggattaggtggataggtgaatggattggtgggtgggtgggtgggtgaagggttgaataggtgggttgggtggatgggtggatggatgtgtggaggggtggtggggtggatggggtttatgggtgaatggatggatggatgggtgaatggagtaaatgagtgggtggatggatggatggatgttgtaagagtttttttggagggttttagggaggaattggtatttttgattagtagttagtatggtgattagatatagggaggtgtttgggtttgtttgattttttattttattgttggtgggattgggttggttatgtgtttttgaagttttttgaagggtggttgtatggtattgtttaggggatatttttagagtgttgtgttttatagtaatagggtggttgtttgtgtttttagggttgttttttttggtagttttttgggtttgtttggtttagtattttagtaaatttttttgagttaggatttgtttgttatgagtttttttaataagtagttttaggttaaggtttgtgtgtgggtagagggagtgtatgttgtgggaggttgtattaatttgaggttttgtttttgtttttttttggggtaaaaggtaaaaatagtttgttttattttatttttaaatttagtttggttgtatttagttttgggagtgaagggggttgggttaggattgtttgtgagttgtagattttggtgtagggaaattttgatttataagatgggtggatatggaggaaggaggagattttgtttagtagagatatgtttgggtgtagtttagtttggagtttgatggatgtgggtttatttgtgtgtaatttttatttattgtgtggttatagggaagtgatattttgtggagatttagattttttatttgtaaaataggggtagtagggtttgggggaggatgtgtgtgaaggtttggtttagggtttttttagtagttagatagtagtggttgttatttttttagtgtttagggttatttgggggagtagggtttttgtttttagatgggttttgtttttggttttggaatttatagtaggagtaaaggtgaggatatttttggtgttaattatttatttggagggagagtgttagtggttttgtgtgatttttgttttttgtttttgtttttaggaggtatgtggatttttagtggttggttttggaggtttggtgattttagtggtttaggtaggtggtttgttttgttttggttttatttagtttatgggtgtgtttgtgttggggtttttttattttggtttgggatttgtttttttatttggtttttttggatgagtggggttatttgtttattttttagggagatgtagtttttgatggttttggatttaggtggtttttaggtttgttgatgttgttttgttggagatgatttttgtgggggtaggggtagttatttttaggtttagggagtaagtttgtgtgtgtgggatagaggagagaataggagatagatagggttggatgatttggtttgagatgttgaggggatagatgtgttatggataggtggttttggttgtgagttttttggtgttggtttagtatttgtgggttttttgtaattttgtaggatggaagatgttttaggatagagtagatatgtttggtgttatttaggaggaaataagtgggtttttggtagtggttattgtgttattttttgtgttttttttatgtgtttggaaattttttatattaattagtagggaagggaaatagatgtatttattagagttttggggttggttgtttaggatatgagttatagtttataggtttgaagggattttattaatattgggtgtagtttgggtaagggagtgggatagagaggttagggttttgtttttagtttttgttttttagggttgagtttgtgtgttattttttttttattgggtgtttttgattttttttgtttgattttagtgtggttatgttagtgtttttgtttttgggagtttatgttgtttttggttgttatttttagtggttaggttgggataggtgtttatttagtggtttttttatttggagaggatgatgggttatagtaatgaatggatttattttttttaggagatgaggagttttgagaagagtagagatggtgtggttatttgtgtatatgtgttgggggttaattgggtgttagatttttggttgttattatggtggtagataggtagggattgtgtttttatgaattagttattttagaggagataaagttattaaaggatatggatttggagttaaatttatataaatagagtgtttgtggattagggttgtttttagaataaggtgagatagttgttttgttaggataaggtgtttatgggggtaagggtatgtgtttatttggagttgttatttttatgttttagattagttttgtttaatagaattttttgtgatggtgggtttgttttatatatttgtattttgttattttgtatggtagttgtttagttgtttgggtttattgtatatttaaagtataaatgtttatgtttattttatttatttatttatttgtatagaattatttatttattttaaatggatttttatttatatttatgtgtggttagtggttatgaaattgaatagttttagattatattggtatttgagattttagaattttagatttaaagtttgtttttgattttgagtttgtttttgtggggatagtatagatgttttttaagtttgttttttagaggtggatgtagtgtttgtggattgtgtattattaggtttggatagtggagagggtggttttttatagggagtgggagtggaggggatgttgtgtttatattgagtgtatgtgaggttttttgtagtataggatgggattgtatgtgggaagaggggggtgatgttttggttggaggtttttgggtagttgtatgatttagtgttgtggttaagaggggttttgtttattgtagttatgttgggtattaattattggatagtttagttgttgttgtgtttttggggagtttttttttggttttgtatttgatttgtttttttattttttttttttttattggttagtttttggtggaatgggtggggagggttttttagtttttgtgggggttgtattttgggaatttggtattttgggttgtatggatatagttttttttggtggttgtttttttttgtttagattggttggttttgtgttgttagtatttggtagttatgattatagtttagtttggaagtttaaggtataatttgttgaattttaaagttgtaagttggtgatttgggtttgtgtgggattgtttgttgatatatggggttttttttttgtgggtttttgtgggttttggtttgagatattttttttttatttttttggtttttttttttttttttgttttttttttgttaagattttggtttaggtaggagtttatttttagatgttttagtatttttggtttttttatttgatattttttagatgattgtttgttattttatttttttagtttagtttttttgtagatttatatttggttaattttttatgtttgggatttttgttttttttagaaggatgaaggttttttttgaggttgtgtttgggattgggttagggatgatatttttggtaaaagtttaaatgatattatgattaatgttttggttagtttatatattttttttttttttaaaaaaaaaatggaatttttagagttataaaataaaaatgtaaagaataaggtaataaaatatttgtgtatttattattttgtttaagaagtgagatattgtaggtgtagttgtagttttgggtgattttttttattttagttttatttttgttgtggtgtttgtttttttggattgggatttggttttgggtaggtatatttgtgttgggtagtggtgtgtttgagaagtttaggtttttttttttttttttttgagatagagttttgttttattgtttaggttggagtgtagtggtattattttggtttattgtaatttttgttttttgggtttaagtgatttttttgttttagtttttttagtagttaggattataggtatttgttattatgtttggttaattttttttgtatttttagtagatatagggttttattatgttggttaggttggttttatatttttgattttaggtgatttatttgttttggttttttaaagtgttgggattataggtgtgagttattgtatttggtttggtttttttttgtatatggttattagtattgtgtgattgagtagtttaggtttgtttttttttgaatgttgttattagtattatatttttggtgttttattggagttagtggttgttttgtttgtgtttataatgtgatggtgtggagatttatttgtgtagatttatgaagttttggtttatttattttggtagttagtgagtgtttttttgtgtggggaggtagagtttgtttgttttgtggtttattggtgatattgttgaaggttttttttgttattagtgttgttgggaatgtgtgtttttttaggtggatttggttgggttgtggagatgtgttttttagtttttttagatgttattattatgtttttttgagtggttttttggtaggtttttttatgtttgtttattttttgtgttttaggtagttgtttttttgattgagtgtttagtggatttttgttttgttttttatggtgtatggagtattttattttagtggtgtttgagtttttttttttttggtttttagattttggttgggatttttggagttaatttttttgtttgatattttgtgttgttaggttttgtttttttattttttaatatttttggggtgtgtggttttttttttagtgtttttattattttttttgttttaggttgaattgtgttttttataaatttatgtttattaaaaattttagaatgtgatttgggagttggagatggggtttttgtagatgtaagtagttaaggattttgagatgaggttattttggattagggtgggttttaaatttaataattggtgtttttaaaagaagtagagaggttatagatatattggggagagttatgtgaaggtaggagtagatgatggagtgatgtagttttaggttagggagtgtttgggaagaggtaaggaaggattttttttttattttattttagagtttttttagggagtgtggttttgttgatattttgattttggatttttggtttttagtatgggagagaatttgtttttatttttttaagttttatagttgtggtttattatggtagttataggatattgatgtattttttatttggttgttgtggatggatgattttgtttgtaggaagttttttttaagtattgtaggtgtttttgtttttataggggatgtttgtataagtaggtgtgaaaaaagggttttgtgggggtaaggtttgggttggtgtttgttgtttttttttattttatgttagtttttatgttttttttggtaggagtgtttggttttatttggtgaattagagttaaatttttttgataattggttgttatttatttaattgttattatttttaggagatagaaaatgttagaagggtggggtttgtgtagtgtttttttgttatttttttagggtattgtgttatgttgttttaatgtatagagtagttgtttaaagtgtgttggatgaataggtgttttatgtttagttatgtagataaaagtgtgttatgtggagggagttggttgtggaagagattattagtattttggttgtttgaggattttgtttttgggtttttgtaggtatttttagtttattatttttttttttatttatagttatttattttttttttatttttttgatattagttttgttatttatttaggtttgtaagtaggaaattttagagttgattttgatttttgtttttttagtatttttaggttttaataggttgttaagattttattaatttgttttttgtatattgatttttggataggttgttttggttatggttatgttttggttgggtttttattatttttttttggattagtaggtgttattttttttatttttgttttgttgtggtttttttttttttatggttaatatttagaggatgattattatttttttttttgtgtgttggggattgggtgataggatttttttatttgattatttttattagatttgggttgggtttttttatttatagagtttttagtttttgtttttaaagttttgagggtggatttgtgttgttgtttagtttggttttgatattgttttttagtttggagttttttgtttttgtgtttttggttttgagtgtttgggttttttttggatgggttgttatttgttttttggaaagtagggtttttatgtttttggattttttagttgatttagtgattttgggttattttgttatattttttttattagtttggttttggttatttttgtgttttttatagttttggattagagttatggtgggatgtttttttggtgtgtggtaggtagttaggaaatattgttggattgattttgataggagatgtttgggagaattgtttaaaaaattagtttaaaatgtaaatattggtttttttttgtgttggttaaagagtagtatttttttgtttgttttttgggtaagaaattgatggtgaatgtaatgtttttagggaggagaagaaggtgataaaaagggtttgtataatggggtatatgttaggtatttgtgattatttaagtttaaattataatataaatgtgaaattttttgttttggtagtttttttatattgtaagtgtttattgttatatgtggttgttatattgattatggtagatatagaatattgatattattgtggagagttttatgggggggtgttggtttagattatttttatgttggatttataaatttattgtttatttagtgaatggttattgggtatttattgagtaagtaggatgaaagatatttgtttttgggggagttttttgttggttgtagagaagtttaaatttaggggatttggggtaaattttgtaagggtttttggtttttgtatttttagattttttttgttttgtaggggtagttgggggttttttttaggaatggagtgttagttttagtttttgttaggttatagtttagatggttggttgagtatgagtatgtgagagtggaattgggtttaattgggttgtttttttttgttgttttggtttttttttatgttgatttggaaggatttttaaagtaataggtttgtttaggtggtttgtattagtaaattttgtagtggttttaagggtagagatagttggattgtatttatttaggaatagttaaagtttgaggtataataaaaagtggagaaagattttagagaggaatgtagttggttttagtttgggaatttgttttgtttgggaggttgtaggtgggttaggttggggttagtttggagggttttggttggttttgttggtaggtatagtagtagggttagtaggagggagtttaggatggagtttttttatttttaatttagggaagtaaattttagtggttgagtttgaggatgagtaggaaatgaatggaaaagtttttttttttttttttttttttttaggtagggtttttttttgttttttaggttggagtgtagtggtataattatagtttattgtagttttaatttgttaggtttaagggatttttttgttttagttttttaagtagttgggattatagttgtgtgttattatgattggttaatttttaaaagaaatgtttttaggttaggtatggtgatttatgtttgtaattttagtatttttggagttgaggtgggaggattatttgagtttaggtgttttagattagtttgggtaatatgatgagattttgttttgattaaaaatataaaaagttagttgggtgtggtggtatagttttgtagttttagttatttgggaagttgaggttgtagtgagttgtgattatgttattgttttttagtttgggtaaagggagtaaggttttgttttaaaaaaaaaaattttttttttttttgaggtggagttttgttttgttgtttaggttggagtgtagtggtatgattttggtttattgtaatttttgttttttaggtttaagtgatttttttgttttagttttttaagtagttgggattataggtatgagttattgtgtttggattttttttttttttttttttttttgtagagatgggatttttttatgttgtttaggttggttttgaatttttggttttaagtgatttttttattttggttttttaaagtgttggaattataggtgtgagttattatatttagtaggaaaagttattttttaaagtgagaggttgtgtgttttttatagtttggtgtttattagtatggaggatttattggaatgtgtgttaggtgaggggatatggaagatggtagtaaatttgagtttagagtattagaaagtatgtttttagttaaagatgtgttttttttatttttgtgtagtatttttttttagtgtgtatttttggagtaaggtggggttgattttatgaagatttttttttgaaggtttttgttgtttatattagtgttatttggattgtttgtttttttttttggatggttggattagttttagggttttttggtttggtgtggggagtatagtttattttggggaatgtttggtatgtgttttttttttattgggtattaggggatgaagttgtgttttgtggaaggggatagaggtgttggtgtttaggatggtgtatttggggtggttgaattggatttggtttttattgggtttttgtggagtttagattgttgtgagaaggggtggggaaaggtaggtgatttgtattttttatttttgttttatatgggaataggggtttattttgtatatatatttagtttggagtatgaatttttatgaagaggaaaatttttattaggttttgatgttaggattgtttgtgagggttgggttgtgttttggggtaaggataggagtggagggggtaattagggaaggttttttaatggaggaggtatttgatagtattttgaaaaagaagtagtttttaggttaagttagagattgaagaatgattatttaattttttttttttttttttgagatggaattttgtgttgttgtttaggttggagtgtagtggtgtgatttaggtttattgtaatttttattttttaggtttaagtaatttttttgttttagttttttgaatagttgggattataggtatgtgttattatgtttagttaatttttgtatttttagtagagatggggttttattatgttggttaggttggtttggaatttttgattttgtgatttatttgttttggttttttaaagtgttgggattataggtatgagttattgtatttggttatgattatttaatttttttttataagatgttttttggttgatgtaaagtaggttgagtgagtgtgatattttttttttgtttgtgggttttggtttttttagagtttggttagtgttattggagataaagtggtttttgttttttttttttgttttgttaggtttagtttgtgttgttgagttttattttgtaattaagaggagttgtgaattagtgatgttgatgttgtagaaaagtggttaggggtttatggggggtgaaggatagggatgttgttttgagaattgtttggaaggggtttttgggtaatagtgtttattttagggtgtgggtaggttggggtggttgggagttgggtttataggttggtataattagagttttttaaagttgtgggtttgagggttttgtttttttgggatagtaatttttggtttaatttgggaaaaggtgggttaaattaagtttggtttttttattgtaggattatttagtgtgtttagtatgtaaatgtgtttttgaatttaagataggattatagaaatttttttagtgtttttttggagggagggattgtgggggatttattgtaggggtttgggtttgtattggtttggtgaagtgtttttttagtgtttatattatgtgtggtgagaggttggtttttgttttttttattttttgttggttttattttattatttttgtatttgttttttagttggtttatgattaatttttgtttttttagagttaattggtgttgttaggttttttattttaagtgattttttgtttgggttaaaatgtttggatttttaggtatggaggggagatggattttaggttaaattatgttgggtaaaattgagggttaaggttgtgtttagtaagtgttttagttttggttgttaaatttatagtgtgtatagtgtgtaggaggtggttgggtgaatgaatttagttatagtttggttttttatttggggttgtttttaagtttttattgttagttaggttgggttagagttttgtggggtttttttgggtttttttgttttatagtaggagtttgtatggagagttttgagtgaggttaatgggtttttttttttttttttttttttttttttaatttgagatagggttttattttttttatttagttagggtgtagtagtgtaattatagtttatagtagttttgaatttttggttttaagtaatttttttgttgtagttttttaaagtgttgagattataggtatgtgttattttgtttagttggggtttttgttttttatttttttttttgtttttaaatttaatataaagaaagatattatatttataattagaaaaattaataaggaatattattttaaaattggaaaagggattaaagaaataaattaagaaatttttgtgatttttgtttattggagttagtggttgttagtggttggtttaatataatgttttaggaagaaatagaataatagaaagtaattttagtgagttgagttttggttttgtttgtggtgttgtattagttttttgtagttgttgtaatgagtggttataagttggttgggttataataatgtttagttatttttttatagttttgtaggttatatatttgagattagggttattaggttgaaattagggtgtttattgggtatagttttttggaggttttagggtaggggtttttagttttgtgtgttttattaggaattggtttgtatagtaggaggtgagtgattggtaagtgagtgaagttttatttgtatttatagttattttttattgtttgtattattgtttaagttttgttttttgtttgattagttatggtattggatttttataggagagtgaattgtattgtgaatggtatatgtgagggatttaggttgtgtgttttttatgagaatttgatgtttgatgatttgttattgttttttattattattagatgggattgtttggttgtaggaaaataagtttagggttttaattgattttatattatggtgagttgtataattattttattatatattataataataatagaaataaagtgtataattaatataatgtgtttgtggttgggtgtagtggtttatatttgtaattttagagtgaaattttgttttaaaaaataaaaaataaaggttaggtatagtggtttatgtttgtaattttagtattttgggaggttaaggttggtggattatgaggttaggagtttaagattagtttggttaatatggtgaaattttgtttttattaaaaatataaaaattagttggatatggtggtaggtgtttgtagttttagttttttgggaggttgaggtagaagaattgtttgaatttaggtggtggaggttgtagtgaattgagatagtgttattgtattttagtttgggtggtagagtgagattttgttttaataaaataaaataaaataaaataataaatataatatatttgaattattttaaaattatttttttattttttggtttgtggaaaaattgttttttttgaaattgattttaggtgttaaaaaggttgggggttattgtttttattgtttgtttttttgagtttttggtggttgtgggtgttttttggtttgtggttgtatggtttttatttttaatattagtatttatagatttttttgggttttatttttatttggttatttttgtttgtgttaaatttttttttgtttttgttttgtatgagtattgagattgtttttagggattatttagattatttagggtgtttttgttatagtaagatttgtaattgaattatagatgtaaaaatttttgttttaaataaggttttatttgtaggtttagggattaggatatgttatttttggggttattatttagtttttttttgtgattatgatttttttttttttttttagttttttattttggttgagatgttgtttttattttttttattgtttggttgtttgtggggttgttttttaggttttttgggaggaggtggttgtttgatgttttttagaaggttgggaatggttttttttattttttaggaagatgttttttttgttaaggagattgtatttggggttttattttaggtagagagtggatgggattgtggtttgaagtggtattttagggtttttggttttgttatttagttgagggttgtgtatgggttttatttggttataggtaatttatttggttttgtggggtagggattgtaaatttagaggtttgtggggtgtgttgaggtagaggggtgtaaatattgtaaatttgttgggggttttggggagtagtatagattgaaaagtgttttgtttgaagagtagaattgttttatattagttttgtgtggttaggtaggaaggtttttgtggtgtggttatgtgtttttttttttttaatagaagttgatagtttggagtttttagagagattgtttgagtttttagttttggtataaatatatattttttttaaataggtttgggttaatagaattagtttttgtgttttgggtttgaatgaatttttgaggtgaagtttaaagatagagaggatgtttttgatttttattttagggatttatattgtaaatttttatttgttttgttgagtttttggttttagtatggattttgattatgtgttggtggggattttttaggtaagtaagtagtttttgaggattttggatgaatagtggggaatagtattgattttttagtggggttttgagtttttggagaggaagatttgtttttttttaggggatggttagagatttattgatttatgtgtgtgtggtaggaattttttaggaagtttttgttttgtttgttttttttgtttgggtggggatggtaattgtttttgttattgtagattaatgggatggaggggggtgattttttagggttttttttgggtaggtgttttggaatttttttttagtatgttggtttggggtatggttgttttttttgtttagttatgttggggtatagggtgaagaagggttggggttagtttaggatagaggaaggtgaggtaggtatgtaggaattgggttttttaaatttttaagtttaaggaaattgtagtattgtgggatagggaaaatgaaagattttggaagttgttaggaatttgattttgtgagttggtttttaagagtttaagttaagtatttttaagtggatattaaaaaggagtagtaagttttggggtggtgggggttggaggaggtggagagaggaggttgttggaagttgtatttgggatttttgtagttattgattagattgggtggttgggattttgggatttttgtaggtagatttggtggtttgttggattttttggggtttattttgggtttttttttttgttttttatttttggattttttttttttgttttttttttttttttgttttgaagagataatgttattttagtttggagtataaatatatgattagtatatggaaatgtggtaatttggatgtatttgtgattgtaatagattgaagaaattagattagataaagagtgtttttagaggaggaggaggaggaggaggaggttgagagagggagggtgatgggggtgagaaaggggaggttgtttttgagtgggatgttgggatttttgttgttgttaaatatatttgtaggaatggagagggattggattttaggtatgtagatagttttttttttattggttgttttttattgttttggatttggggttttatttatgtttgggggaataagtatgtaaagggtgtttttgtttattttttatagaaatattttttttttttttgatggttttaagtttgtgggatgaattttgttttagaagttaagtttttttgagtttggtttttatttaaatttggttttttttttttttggttattttttttttattttttagtgtgttatttttgtatgttatggttattgttaatgttgaggttgttggtgttgaaattttgggagggtgtgggggatttgtttttttggtttgggtttggggtggtggtgtttggatttggttggtggttggtttgtttattgtgtggtttgttttttgtttttagttaaagtttgtttttaaggttgttttggttttttatttaaaatagtatttttgtgtttttttggtagttgattatagagggggaagtttttggtgtttagaggagtttggtgtgtgtgtgtatgtgtgtgtgtatgtgtgtgtgtgtgtttatttatgttggtagtttttttgttgtaggtatagatttattagggtgtgaataggtaaatgaagagaaagggggtttttttgtttttagtttattttagttttttaggtttttttttttaggtttagtttttttggtttttttatttatatgtggtgttgtggttgttattttatgtggttagtgttgttattggtaattagtagtgatgatagtttttgttgtttatgttgttttttgagtttagtgttgggagatatggggtggttgagttaagttttaggttttgggtattttgaagtgatttatgggttatggagtgggaggttgttaagagtgttaatttttatgtgttttgggttttggtttgttggttgttattatgtgtgtgttggggggtttttgagaggtttgagagagggaggtttattttggtggtttttttttaggatgtgtggttttttttattattgtttttagggttatatttttttttttttttttttttgagatggagtttggttttgttgtttaggttggagtgtagtggtgtgattttagtttattgtaagttttgtttttttagtttatgttatttttttgttttagttttttaagtagttgggattataggtgtttgttatatttttttgtatttttagtagagatggggttttattgtgttaattaggatggttttgattttttgattttgtgatttgtttgttttagttttttaaagtgttgggattataggtgtgagttatggtgtttggttttagggttatattttgattgttatgttgggattggtggagtgggtgtgtgttgtgttgttgagtatatttagttgggtatagtaggtggattttaggagggggttaggggagatggtagaaggtttgggtggtagtgaaattgtattttatttgtttgagtttgggggtttaggtttgttgggatgggtgggtgtggagtttagtgttttgttttttgtttagtaggagttgtagggtagggagtgttgagagggatttttgttaggtttgtatagtggagttgtttttggagtgattattttattaggtagtttgggtagattatagtgggttttttgttttttgggttattagttttaggaggatgttattttatttgtttggttggtaggggttttggggagttttgggtttggtttttattttatagatgatttagttgaggtttagatgggtgattagtaggggatttgagagttgagtagagaggtgtgggtttgggggtggtgttttttggggagttggaagtgatggtatttttttaggtttataaaatatgggttttttatgaattgaataaaatattttttgaaagtagttagtgttgtgttttagagattattttgatttttgttgtttttggttgaggatagtatagttagggatgaagtggggatttttttttgggttgtgttttgatgaaagatgttttttataaaattttatttggatgtgtttttatgtaagaaaatgtatatttttagaaatttagttgtaaattggttgttttttgaatgaatatgatagttttggagttgttttttttaatgaggtttttgttttgggtaaattttagtgttggtttttaattgttattgaatttttgtatagtttttggggaagtgattttttttttgtttttgttgggtggttttgagtaagttatttggtagttttgggttgtagttttgttatttgtaaggtgaggggtgggagtggtatggtttttaggtagtgtttttattttttgtgggtttttgtgtgtgttttgagttttgtgggtgtttttttttttattgaggggttttttttttttgtagggtatggtttatgttgtgttgttaggttgtaagttattgtgagagttgttttgatttttaagtatgttttggtttgaggaggagttatggggaggatgttgtgtttgtgtgatagaggtttgtttggtagatgttggtttgttgatttttagatgtggttgtgggtgttttatgttttattgggttggtgtgtgaggtgtgtttagtttaggttgttttatagttgtttaggaagggtttgtgggagggggtggttttattttggtgagtttatggtggtttgttagttttagggaaggtttaggagttttaagatttgtttttttgttttttttttggtagtgtttggttttggtttggtttgtgaatgggggtttgggtatttttttgttttttttgggggttgtggtttttttttgggaaggtgttggagggtttgttagtagggttggtatgagttatggagtggtgattggttgttgaggtatggaaggttattttttttagttaagggttggagttttttttttgttttggaatggttttgtggtttttataaattaagtagttttattttgttttaagagtttgtattttagtagggagagagtttttaagaagggaattttttattggggagttttgttgggttgggaggttaggaataggttatgagggagggttgtaggtaggggaagtggttgtttgtgtatggttatgaatgtaggtttggggttttggagggggtttggttatgttgttgttggatgtttgtttttattagggtttatttgatgtagtatggtatagggtaaagtttagttttttttatggggtttttgggttattagtgggtggggaattgaggttttttggagggtggtgttttagtttttattttttttttttgttttttgttgtgttgtttttgatggtttttgttattttttgggagtttttatttttggatgtttggtgtttgtttggttttaatttttttagttttgtttttttatttttgaggtgagaggtttggtttgatgtgttttgtatttgttttttgtttagttttgtgggaattttggtttttgtagtggttttttggggttgttattattaagtgttataaattgggtggtttaaaatattagatatttttttttttgttgttttggaggttagaagtttgaaattatggtattagtaggtttggttttttttggaggttttgagggggagtttgttttttgtttttggtagtttttggtggtttttgaaatttttggtgttttttggtttgtggttatattatttgatttttgtttttgttgttatggggtttttttttgtgttttaaatttttttttgtttgttttttatatggatagttttttttggatttagggtttattgggtaatttaaaatggttttattttaagatttttaattttataatgtttgtaaagattttttttttaaataggttatgtttataggttttggggtggatgtaaattttaggggttattttttatttttttgttgtttttgtgtgtttggatgtatagtatggttttatgttttagattttttgttggatttttttggttttttggggtggtttttggttttttttatttgtttttgtgtttttggtgaggtgttggggttgggtttagtttttgtaggaattttggggatagtatggagttggtaattttttattaggtgtttttttatttgtttagagtttatggttgtgaggggtttttttttgtggttttgatttgtaattttttagtggttagtgatgttgagtatttttttgtgtttattgtttatttgtatatatttttgtagaaatgtttgtttaagttttttatttgtgtttgatttggatgattgttgttgttgagtgttaggagatttgtagattaatatttagatattaattttatatttgatttatgatttgttgttattttatggattgttttttttttatgttgttagtgttttttgatatgtaatttttttttttttttttgagatggagtttgattttgttgtttaggttggagtgtagtggtatgattttggtttattgtaatttttgtttttttggttttagtgatttttttgttttagttttttgagtagttgggattataggtatttgttattatatttagttaatttttgtatttttagtagagatggggttttattgtgttgattaagttggttttgaatttttgattttaagtaatttatttgttttggttttttaaagtgttggagttataggtgtgagttattgtatttaggttgatatgtaaatattttaaatttttatgatgttttattttatttatttgtttttttgttgtttgtgtttttggtgttatatttaagaaattattgttaaatgtaatgttaggaagttttttttttgtgtttttttttaagagttttgtggttttagtttttgagtttaggtttttgatgtaagttgagttgatttttgtatgtggtgtaagggttggtttagttttatgttttgggtttttgatttattttttttttttttttatgtttagttggttttgttgggtggtggggaggagtggggaagttttgggttgggtttgtatttgattatttttttttaggttagttagggagttttagtttttgtttaggatttggttggatgtgttttttattgggaaagtttgggttgtttttttaggttgatggtagggttagtttggggtgttttgaggtttgttttgtggatatgttttttgttttaggtggtgtggttgtttggtttgtgtgtgagattagttgtttgtgttttaggttatggaggttgagtgtttttagtttgtttttttgtttggttttttttttggggaagtttttgtagtttattttttgtttttgtttttgttatttgtgtttttgtttgttttttgtttggaggtggttatttttggggttattttttatgatttggatataagtttttattttgaagttattatttaaatttttgtgttttaaattttttttatttattatatgggtttttattgtgattaatttagtagttgatgaagttttttttggggtttttttagtaatggggagttggtttttttggaggtttggtttttttttaagtggaagtggggtgtgagggtgttagtttttttttgttgtttggtgttttaggttggtttgttatttttggaagtatttgttatttttatatagtattttatatttatttttttgttttttatttttttttttaaggggttatttttgtttttttttttatttaattttatttatgtggtttgtttagtaatttttgatttttaatatgataaaataaattttttttgttggttatttatttatttatttagtattgggtgttttttgtggatttggtgttggggttttgtggaggataaagttagatatagtttttgtttttatgggattgtataagtgtaagattatattagtaaatgtgaaatataggaagtgataggtgtgataaaggggattagtggtaggatagaatttgtggtttgtaggattaggttaggagggttgttttggggggatatttttgggttgagtgtagaaggatgaggggagtaaattaggtttaaatttagtaggtagaggtgattgttgtaggtaattggtaatgtgtttaaaggttttggggtgtggggggttgaggttggtagtatggtaggaagtaagattggggttgaaagagattgattgttatgttgtgaaatatatatttggtttttatttttattttttggtatataatttttaaaatttttggaatttttaaagtgatgtttttttggatgtttatgattgatagattagttggtagttttaggatggtttttagggaagattaggtagaattataaggtttagtattattttgtaatttttaggtaggggagaggggttgaaggttaagtagattattagtggttaatgattgaattaattatgtttttgtaatgaggtttttgtgaatatttagaaggatggggttttgggagtttttggatggatgagtatgtggaggtttttggagggtggagtgtttggggagtatatggaagttttgtgttttttttttatattttgttttatatatttttttttttgtattttttgtaatattttttataataaattagtaaattttatgagttttaggaatatgtgtaaaagaaaaaaaaaagaataaattatagttgttgtagtaagttaattttattagtattggtttttatttgttgattttatttttggtaatgttttttttttttgggtttttgggatttttttggttttattattttttttgtagtggttttgttggttgttgtttttaggttagtttatttttatttggtttgtttttattaggggttgaggtttttttgtttattttagttttttggtttgttttttgttttgggtatttttttattttgaatggttagagtttttgaagttgtttgttgtgtgtttttgtttggttttatgtattttgtatggtgttttttagggttttttattggtaagggtattggtatagattttggggttgttttggtttaagtttattttgatttggagtttgagggtttttgagggggttttgaaggttagggtaggtaaggttggtatgttttgggtagtgggggttgggtatgggaggggattgtgggtggggagattttttttaattagtggtttatgtttggagattgatttgggttttaggttatgttttgaaattgggatagagagtggtgtagattttagtttggagattttttttgtttgtggatgtttttatatttttatttgtggagttatttttttttttttttttttaaatggggaaattttgatttgaatattgaataaataatatatttttgaaattagtgaagaggtattggttttgaaattttgttatgaaagtttgaaaatgttttttggattgatttgttggaatagatgggtgtgatggggttgtggggttttaggtggtaggaggtgtttttgtgtttagggtattttgatgtttagagtttttttgtgtttagtgtgtttttgtatttagggtatttttatgtttagggtgtttttgtgtttagtgtgtttttgtatttagggtatttttatgtttagggtttttttgtgtttagggtgtttttgtatttagagtatttttatgtttagggtgtttttgtatttagggtgtttttgtttttagggtgttttgtgtttagggtgtttttgtgtttagtgtgtttttgtatttagggtgtttttatgtttagggtgtttttatgtttaggtattgtttttttttatttttttaatttttttttattaataggtgttagttgtgaaatgtttgttgtgtgtgttttttggttgagtttattttgtgtttttaagtttttgttagatataggtaggttgttttagtttttttggtaaatgttttgttgttgttgtttgatatggggttttattttgttatttaggttggagtgtagtggtgttattttgttttattgtaatttttgttttttaggtttaagtgatttttttgttttagttttttaaatagttgggatgataggtgtttgttattatgtttggttaatttttgtatttttagtagagatggggttttattatgttggttaggttggttttgattttttgattttaagtgatttatttagtttggttttttaaagtgttgggattataggtatgagttattgtgtttggtttgtttggtgaatgtttattgaggtttattatgtgtagttttttttttaggtgtttggtttgtaatgaggagtaataaagatatagttgttggttgtttgttatttaatagttggaattgagaggtagtttataaatgagtaaatttataggtggttttagatgaggattgtgaagaagttaagaataggttgttgggggtgtatatttgtgtgtgtggtgaggggattaatggaagttttttttgagtggtgatattgagttgaagttgtaatgattagaaggatttagttaggttaaaatttaagggaagagtaatttggtaaaggaaatagtaggtgtgaaggtttgaggttggagtttggggaaggtgggagtggttggagtgtgtttttagagatgggttatggtgatattaatgtgataggtagggttaggttgtgttgggttttggaggttttggtgagggtttgattttatttttattatggtgggattttagtgttttgtggttgttgagaatggttaggggtaggtagggaggtttgttagggaggaggttgttgtaggttttgtagttggagagggaggattaggatttttttagagaggaagttggagagggaggatttttttgattgttggatggatttatttgtttggttgtttttgttagtatttagtagaggttattggatgttgataggtggttggttttgtttagttttgtattgttttgtgttgttttggtggttgttggttttaggaggagtgtttttggtgtttgagtttagtggttttggttgtggtttggtatatttggttgtgggtgaggttaaggtggtttggattttgggaaggttgggtatttggtagttttaaggtaggagttggggtgttggaggaggaagtatgtttattttttgtttttttttgttttgtgggatgttgagtttttgggtagggatatggtgagttttggtgtgatgtatttaatatttgttggtgtttttatttttaagtaggaattttggtgtttggtgtttgaggattgttgtttattgttttattattttttaggtttttttttagtttttgatttggggtaaggtttagatatttagaatatttttggttggtttttggagttggggtgaggtagaattttttttttatatttatagtattagttaaggttttggggtttggatattatttttgggaggggtgagtaggataagtgaggtttttagatttggggtggttttggattggttaggtaggtgggtgggggttgtagtttatgtttttgttttaggtaatatagttgagttgtagtttttgttttatttttagttggggttttttgtgtttattttttgtttttttttttttttttggaatggggggtggatattttaagattagttttttagttattttttttgttttttgtttttttttttttgggatagatttttgtgattgttgggtgtttttgatgttttgttttttttgtgttttgtgttgtgggtgagagagggttttggggggattttttttttttggagtatttgttgttttgggtgtttttgggggtgggtttttattttatattgtggagttggtgtaggaaggaaggtgttgggagttagttttaatttatgtgttggttgtggtttttaaggtgtggatggtaggaggtggtgagatagggatttattgattatgggattgatatttttttatgttgatgtgggttttgagttataattttattagtttttgagttttggtgttgtttttggtgatggtgtggatttagttaggtttttgggtagttttttttggattttttttttgtttttttttgggtagtgtttttgtttatttggaaaggatgggtaggatttggagataatagggatttaaagaagttgggagtgggggtatttgtgtagtttattttgtagaatagataatttggttaaagtttaaagtttgttgttaggagttttgtttgttttttagagagtatatggtttgattattatggggattgggggagaggtataggtatgtttgtttggtagtagaagggaattttgggtttgggtttttttattttgtggtgttgtttttttttagagttgtattgttttttttattgtttttgtttggttttagtgtttatgtggtttgtggtttttagtttgggtttggttttttgtaatttattttgtttagttttatatagtttgtttttttagttgggaattggagtttatttggagttttaggtagtagatttgatgtagtgatgtagggttgttagttatgttagtaggttttgttgtttatagagggatgggtattgttgttgataataattaaagaattatggttttaggttgggtatagtggtttatatttgtaattttagaattttgggaggttgaggtaggagaattaattgaatttaggagttttagattaggttgggtaatatagtaaggttttgtttttataaaaaataaaaaataataataataataaaaattatagttttagaatgattgattttagtatgtttataaagttaagggtttttagtgttttgggtttatgttattgtgttagagggagagaggaagaggttggggtgatgggtattggggtttatgttttttttggaatgggtggttttggattgtgtttgtgtgatatgtttgttgagtgggggtggtgtttattgaggattggatgttgaggtgtgggtggggggaggttatgaagtattgggtattttttgtgtattagtgttttgagattgtagagaggggatttgtttagtttgggtagggaggtgggtggtagtgaggaaggggagaggaatttgggtgtagaaagttttttttttagtaggtggtgttgtaagtttttgagagtttagtttttgtggggtttgtatttttattgaatttgtgggtagaggttgtttgggtgtagtttttgttaattgtgattgtttattgtgggtgaggggaagtggagtgtagagaatgtattggagggtagatgattagtttttgtataggtatgggggtgtttttttttttgtataggtatggggggtttgagtttttggggtttttgttttaattgggtggggaaagggagggttggaagttgagttagggggaaagggggtggttttttgttattttttttattttattttttttatttttggttgataggttttaattttttttatatttttttaattttttgttgtaaaattttttaaatatagaaaagatgaaagagggttgagtgtggtggtttatgattgtaattttagtattttgggaggttgaggtaggaggattatttgagtttaggagtttaagattagtttgggtaatatagtgagattttatttttataaaggatataaaaaattagttaggtatggtggtgtaggtttggagttttagttatttggaaggttgaggtgagaggattgtttgaatttgggaggttgaggttgtagtgagttgggattgtgttaatgtattttagtttgggtgatagaataaaattttgttttaaaaataaaataaaataaaattataaaaaagaaattatgaaagattttaaagtaaatatttatgtatttattatttagattttatagtaattattttgttgtttgttttattataaatttttttggttattagtatttatgttggttttgatgtatttaaaataagttgtagaaattagtatataatattttgttaatattttagtttgtattttattaattagagtttggtatttgtttgtgattatttttgtttttttttgaagtaaaatgtatatattttgagatgtataggtgtgaaatgttttgttttttgaattttaataaaggtatttatgtgtattttagtttgattagaatatagaatattattattattttagtaagttttttatgtttttttaggtgtattatagtttttattttttttagggtaattataattgtgttttttttttattatgaaataattttgttagtttgagtgttttttagagttatttatgttgttgtaggtgttagtgatttgttttgttttattgttgagtaatgtttattgtgtgaatattttgtgggtttttagttatttttttgttgaaagatttttggttgtttttatttggaggtttttatgagtaaatttgttatgttggttttttttgtataagtttttttgtgtatatgggtgtttatttattttgtagaaatatttagagtaggtatagggtaggtatatatttagttttataagaaattgttagatttttttttaaagtggtttttttattttatatttttattagtaatggatatgagttttagttgttttatattttggttaatatttggtgttgttattttgtgaaattttagttattttggtgggtgtgtagtggtattattttattatggttttaatttgttttggtttgatgattaatgtggttgagtatatttttatgattggttttttatatattttttttttgtgaaatgtttttttaaatttgttgtttattttaaaattgggttgtttgatttttttttttggatattgattttttgttagatatgtgttttataaatattttattttagtttgtggtttgtttgtttattttttttttttttttaagaataaggttttgttgtattgtttaagtaggtttgaaatttttgggtttaagttgtttttttgtttttgtttttttaagagttggttttataggtatgagttattatgtttggtttgtttatttttttagtggtattttttaataagtaaaagtgtgttattttaatttttatgaagtttaatttaataaatttttttttttgtggttttttttttgtgttttttgtaagaaatttttgtttattttgttaaattgtaaagatatttatgtttttttttagaaggtttagagttatatagtttttatgaattaatttttgtatatggtgtgaggtagagggttagggtttattttgttgttgttttatgtgtttatttagttgttttaaattttatttttttttaaagtttttattttgtatttttttggtgatttatgaggttgtataattttttaagatttttgttggttatttatgtatttttttttgtaaaattatttgtttatgttttatttttttttaaaattatgttgttttaagattgagtgatttttgaagtttttattttataatgtttgaaagaatgaatattttgttttttagttataggtttttgttttttgttttgtagttgtatagtggggtaagatttgggttttgttttgttgttgttttgttgtttttttatttgattgtttttttatgggttttatttaaaaaaaaaattggttgggtatagtggtttatgtttgtaattttagtattttgggaggttgaggtgggtagattatgaggttaggagattaagattattttggttaatatggtgaaattttatttttattaaaaatataaaaaattagttgggtgtggtggtgggtgtttgtagttttagataattgggaggttgaggtaggaaaatggtgtgaatttgggaggtggagtttgtagtgagttgagattgtattattgtattttagtttaggtgatagagtaagattttgttttaaaaaaaaaaaaaaaaaaaaatgttgttttatatgttttttatatattttggatataagttttttattagatatatgtattataagtttttttttttatattgtttttttttttttggtttttttaatgatgttatttaatgagtaagagtattttgtttttataaagtttaatttattaattttttttagttttgatttatgatttttgtgatttatggaggaaatttttgtttatattaaggttaaaagaagtttttttattttttagaaattttatagttgtatattttatgattttttttattttttaattttttaaatttttatattttttaatttattatagttgttaggatgttgtatgatttattttaaattagtttttgtatttggtttgaggttagggttaatttttgtttttttatatttatatttagttttagtattgtttgttgaaaagatatattttattttattgaattatttgatatttttgttaaaaattattgattgtatatgtggttttatattagtatatgtatgtatatatatgtaggttttgtgttgattgtatgtgtggttttatattagtatatgtatgtatatatatattggttttatgttgattgtatatgtggttttgtattagtatatatatattagttttatattgattgtatatgtggttttgtattagtatatgtatatatatatatgtaggttttatgttgattgtatatgtggttttatattagtatatgtatatttatatatgtaggttttgtgttgattgtatatgtggttttgtattagtatatgtatatatatatatataggttttgtgttgattgtatatgtggttttgtattagtatatgtatatatatatatgtaggttttatgttgattgtatatgtggttttgtattagtatatgtatatatatatatataggttttgtgttgattgtatatgtggttttgtattagtatatgtatatatatatatgtaggttttatgttgattgtatatgtggttttgtattagtatatgtatatatatatatgtaggttttatgttgattgtatatgtagttttatattagtatatgtatatatatatatgtaggttttatgttgattgtatatgtagttttatattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatgtggttttgtattagtatatgtatatatatatatgtaggttttatgttgattgtatatatatatgtggttttgtattagtatatgtatatatatatatgtaggttttgtgttgattgtatatgtggttttgtattagtatatgtatatatatatatgtaggttttatgttgattgtatatgtggttttatattagtatatgtattgtatatatgtaggttttatgttgattgtatatgtggttttatattagtatatgtattgtatatatgtaggttttgtgttgagatattattgtgtttttttgatattttgtttatttttttgttgatgttatattttgattaatgtggttttatagtaagttttaatataaagttttttaaatatttaaaatattattttgaatattttaggttttttgagtttttttataaatttaagaagtagtttgttgatgtttataaaaatgtagtgtgaattttggttgagattgtgttgaatttgtagattaattaaggaagaattggtattttaataatattgagttttttgtatagatggtatatttttgttttaaaggtttttttgtattttttttatttttttattgaaaaaaaatttttatagaattatattgttttgtagtttttaagaaaaagattttgtatgttatttgttaaatttatttttaagaattttatttttggtattattttaagttgaaatagattttaaattttatttttaattatttgttgttagtatgtaaaaatataatagatttttgtatgtaaattttatattttatgattttttttaaagttatttattattttggtaatggttttgtaggttttttaggatttaaatatatagttttatttttttttgattttgatgttttgttttttttttttgttttattgtattggttagagttgttagtttagtattgaatagtagtgattagtggatatttttgtttgtgttaaatttataatgttaattttagatttgttatatatgatttttgttagattgaggaaatttttttttatttttaatttgttgaaattttttaatatgaatgggtatgattttagtaaatgttttttttgtatttatggaaatgattattgttttgttttttatttgtttaataggataaattataatgattgatttttgttttttgttttttttttttttttttttaaagaaatagagttttatttttgtttaggttgtagtatagtggtgttattgtagtttattgtagtttgaatttttggatttaagtaatttttttattttagttttttaagtagtagggattataggtatatgttattatgttaagttaatttttaatttttaaaattttttgtatagatggggttttattgtgttgtttaggttggtttgtaatttttgagtttaagtaatatttttatttttgttttttaaagtgttgagattataggtgtgagttattgtgtaggtttgattttttaatattgaattaattttgtatttttggaagaagtttaatttgtttatgagatattattttttttatatattgttaaatttgatttgtttagtttttaaggatttttgtgtgttgatttatgagggatattggtgtggtattttttttgtttgttagtttgttttggtaatgtttttgttagttttattttggttttataaaattagtttggaagtgtttttttttttttgttttttgtgtttttataaggttgatgttgttttttttttaaatgtttgatagaatttattaagaaaattgtttggatttagaattttttattaggaaaggtgattgtttgtttttaattataaatttaatttaatgtatagaaagagttatttaggtttttttatttttttttgttttatttttggtaagttgtattttgaaggaatttgttttttttaggtaagttgttgaatttatttatttaaagttgtttgtaatataagtatatttagggtttgtttttagattttggtaataaagtaaatattgtaataaagtatgttatataaattttttggttttttagtatatataaaagttatgtttaggttaggtatggtggtttatgtttgtaattttagttttttgggaggttaaggtgggtggattatttgaggttaggagtttgagaatagtttggttaatatggtgaaattttatttttattagaaatataaaaattagttgggtgtggtggtatatgtttgtagttttagttgtttgggaggttgaggtgggagaattgtttgaatttgggaggtggaggttgtggtgagttgagattatattattgtattttagattgggtgatagggtgagattttattttaaaaaaaaaagaaaaaagttatgtttatattatattatagtttattaaagtgtataagattattatgtttttttgttaaaaaatgttaataattatttgagtttttagtaagttataattttttttttggtagaaggtttgttttaatgttgatggttgttgattaggtggtggttgttgaaagttgaaggtagttgtggtagtagtttttttgttttttttttttttttttttttttttgagatagagttttgttttattgtttaggttggagtgtagtggtatgattttagtttattgtaatttttgttttttgggtttaagtaatttttttgttttagttttttgagtagttgggattataggtgtttgttattatgtttggttaatttttgtatttttagtagagatagggttttattttgttggttaggttggttttaaatttttgattttaggtgatttatttgttttggttttttaaagtgttgggattataggtgtgagttattgtatttggttggtagttttttaattgaagtttttgatatgggttgatttttttttttatgaaagatttttttgtggtatgtattatgtttgatagtattttatttataatagagttttttttaaaattagagttaatttttttaattttggttatggattgattaaataagttgatgtaatattttaaattttttgttgttattttaataatgtttatagtatttttgtttggagtagattttatttttaggaattattttgtttgtttatttataagaagtaattttttatttgtttaagtttgattatgggattgtagtaatttagttttatttttaggttttatttttaattttagttttttgttatttttattatatttgtagtgattttttttgttgaagttttaaattgtttatttatgagggttggaattaattttttttaaatttttgttaatgttgatattttaatttttttttgtgaattataagtgtttttaatggtatttagaatggggaattttttttagaaggtttttaatttattttgtttagatttattagaggaattattaattatggtagatattgttttataaaatatattttttaaataataagatttgaaaattaaatttattttttttttatgggttgtagaatgggtgttatattagtaggtatgaaaataatatttatttttatatatatttttgttagagtttttgggttataaggtgtattgttaatgagtaataatattttgaaaggattttttttttttgagtagtaggttttaatgatttttttttttttttgatggagttttgttgtgttatttagaatggaatgtggtggtatgattttggtttattgtaatttttgttttttgggtttaagtgatttttgtgttttagttttttgagtagttgggattataggtatatattattatgtttggttagtttttgtattttttgtagaaatagggttttattatgttggttaggttggttttgaatttttgattttaggtgatttatttgttttagttttttaaagtattgggattataggtatgagttattgtattgggttttatttgttttttttttgttgttgttttttaattgagatagagttttgttttgttgtttagattggagtgtagtagtgttattttagtttattgtagtttttgttttttaggtttaagtgatttttttgttttagttttttgagtagttgggattgtaggtgtgtattattatgtttggttaatttttgtatttttaatagagatgaggttttattattatgttggttaggttggttttgaatttttgaatttaggtgatttgtttgttttggttttttaaaatgttgggattatagttgtgagttattgtgtttggtttttttttgtttttttgtttttttttaaattgagatagagtttttttttgttgtttaggttggagtatagtggtatgattttggtttattgtaatttttgttttttgggtttaagtggtttttttgttttagttttttaagtagttggaattataggtgtgtgatattatgtttgaataatttttgtatttttagtagagatgtggttttattatgttggttaggttggttttgaatttttgattttaagtgatttttttgttttagtttttaaaagtgttgggattataggtgtgagttgttgtattaggttttaatgggtttttaatatttagtaaattatgttgtaaatagatgtgttgttaagtagggtttgttattttatttttgaagtatagatagaatagatttggtagaatttttaagggttttaggatttttggaatggttaatgagtattggttttaatttatggttaatagttgtgttagttttttatgagagttagtttgttttttgaagttttaaagataggtattgattttttttttttagttatgaaaattttagatgatatttttttttagtagaaggtgggatatttatgttgaaattttgttgtttagtgtagttatttttattagtgttttgagttagattttttgggtaatttgttgttgtttttttattagtatttgttgttttattttgtatttttatattatagagatggtttttttttttaaattttatgatttgatttttgttagttttaaattttttttttttagtttttttattttttttagtttttatattattgaagagagttagggttttgttttggattaggtttttgtttaagggaatgttgtggttgatttgattttttatttagattatttaaattttttttatattagtattaaggttgttttgttttttttttttttatgtgtgtattggaattgtatttttaattttttttaataatttttttttggtatttataatttggttagttatttggtataagagattttatttttgtttgttttggtttttgatatgttttttttatttagtttaattatttttagtttttgatttaaagtgagagatgggtgatttttttttttatttgaatatttagaggttattgtagggttattaattggtttaattttaatattgttgagttttagggaatagggatgtttgagtagagggagagagagtggggaatagttagttagtggagtagttagaatatataatgtttattgaataagtttattgttttatttggatgtggtttgttatgttttaaaaataattgtaataatggtattgaagattattgattattgggtgtggtggtttatgtttgtaattttagtattttgggaggttgaggtaggtggattatttgaggttaggagtttgagattagtttggttaatatggtgaaattttgtttttattaaaaatattaaaattagttaggtgtggtggtgggtgtttgtagttttagttattggggaagttggggtagaagagttgtttgaatttgggaggtggaggttgtagtgagttgagattatattattgtattttattgtattttagtttgggtaatagagtgagattttattttaaaaaaaaaaaaaaagggttgggtgtagtggtttatgtttgtaattttagtattttgggaggttgaggtgggtagattatgaggttaggggattgagattattttggttaatatgatgaaattttgtttttattaaagatatgaaaaaaatagttgggtgtggtggtgggtgtttgtagttttagttatttgggaggttgaggtaggagaatggtgtgaatttgggaggtggagtttgtagtgagttgagattgtgttgttgtattttagatagagtaagattttgttttaaaaaaaaaaaaataaagaaagaaaaaagaaaaaagagattatagattattatagtagatataataataatgaaaaagtttgaattattttaagaattattaaatttttatatagagatatagtgttaatatgttgttggaaaaatggtgttagtagatttatttgatgtagggttgttatgaatttttaatttgtaaaaagtgtagtatttgtgaagtataatgaaatgaggtgtgtttgtgttttttgttattgtaatgttggtaggatttgtaaggaaaatattttattttttttattgtgattttatgtttgttattttttttttattagtagtttggttaggaggttattaatttagatttttttaaagaattagtattggattttttttttttggtgtttatttttttgagtttttttgttatttttattatttttttttttgtatttgttttagtgtattagttagggtttagttaggaaataaaaattatattggtaatttgaatagtaatttgtaatataaagtgtttttaattgtaagaggtagttaattattaaagggattataaaggggtgatattgtgatataagaaagatgtatttgggttgggtttggtgtagtggtttatgtttgtaattttagtattttgggaggttgaggtaggtggattttttgagtttaggagtttgagattagtttgggtaatatggtgaaattttatgtttattaaaaatataaaaaattattttggtgtggtggtgtgtgtttgtggttttagttatttgggaggttgaggtgagaggatagtttgagtttgggaaggtagatgttgtggtgagttgagattgtattattgtattttagtttggatgatagagggagattttgttttaaaaattaatgtatttgtttgtttgtttgtttatttatttatttatttatttatttatttatttatttagtttttgttttttaattttgtttggtatgtagtttttaaaatttttgaaatttttaaagtgatgggtgtttttttgtttgttaaggaggtgattggtggttggaggtttttggatagtttggggataagggttggttgttaggggatttagttttgtgattagaaggttagaatttgtagttttttttatttattttttgtgaggtaagaggggatgaaggttgagttgattattaatggttaaagattttatgttatgtttatgtagtgaagtttttttgaaaatttaaaaggatgaggtttgtagagttttaggttgttgaatatttgtaggtgttgggagggtagtgtatttttttgtggaagttttatgttgttttttttatattttttttatgtattttttttagttggttgtttatttgtattttttgaaatattatttgtaataagttagtaattttaagtaaattgattttttgggttttgtgagttatttaagtaaattattgaatttgagaagggagttgtgaagattttaaatttgtagttaagttagatagaagttatgggtaatttggtgttttattatttgtgattgatttttgaagttgagggtagttttgtgagatggaatttttaatttatgggatttgtattaattttggttggtgttagaattgaattgaattgtaggatatttagttggggattgttgagtattggagaattgtttgggggttggtgggaggaaattatatatttggtgttagagttgaagtattgagtgttgtgaatgagagtggagagatagagtttgttttgttttatgtaagaggattttaaggagtatagaaagagtaaatatgagaagtagttattttagaagaaaatataggaggaaagttttgtgatattggagttggtaatgtttttttggatgtgatattgaaaatataataaaagaaataaatgataaattggattttattaaaatttaaaatttttgtgtattaaggaatattattaatggtgtgaaaaggaaatttatagaatggaagaaagtatttgaaaattgtatatttgataaaggattagtatttagaatatataaagaatttttataattaagttataaaataaaaaaaaataatttagtgaatagatatttttttatagaagatatattaatggttaagaagtataggaagagatgtgtagtgttattaattattagggaaatgaaaattaaagttataataaaatatgattttatattttttaaggtggttgttagttaaaatatggataatagtaagtgttggtaaggatatggagaaattggagttttgtgtattgttggtgggaatgtaaaatggtgtagttgttgtggaaaagatataataattgtttaaaaaattaaatttagaatgattataatatttagtgattttatttttagatgtatattttaaagaattgatagtagggatttgaataggtgtgttatatttttgtttgtagtagtattttttttataattaaaagatgtaggtaatttaggtgtttattagtggatgaatgaatagataaaatgtggtttatttgtatagtggaatattattttgttttaaaaaggaaggagaggttaggtgtggtggtttatgtttgtaattttagtgttttggaaggttgaggtgggtagattatttgaggttaggagtttgagattagtttggttagtatggtgaaattttgtttttgttaaaaatataaaaattagttaggtatgggggtatgtgtttgtaattttagttattagggaggttgaggtaggagaattgtttgaattagggaggtggaggttgtagtgagttgagattatgttattgtattttagtttgggtgatagagtaagattgttttaaaaaaaaaaaaaaaaaaaaaaaaaaaggagattttgatatatgttatagtatagatgagttttgaagatatgttaagtgatagaagttagatatgaaaagataaatattgtatgattttatttttatgaggtttttagagtagttaaatttagagagatagaaagtgggatggaggttgttagaggttgggggaagggagaatgaatgggaagttggtgtttaatggggatagaattgtagtttgggaagatgagatggatggtggtgatggttatataatagtgtgaatgtgttttatgttattaaattgtatatttgaaaatggttaaaatggtaaattttttgtgatggatattttaaggtatgtatgtaaatatatagaagtagttattattattggggttgatggaaaagaaattaagaatttggagtgttttttatattttgttatgttttatgtttaggttttgttggagagtgtgtgattgttatagaaatttgtagtttattggtaataaaaaggtttttgttagaaggtgtagaaagagtggatttgtaggattagtttattgggtagttgagaaatttattagagggtatgggtgggtaggagttgggtgtttgagaagtttgttgaggttttattgggttagagttggggtgttggagaaatttagtatagagtaggttttattgggtatatgttattggtagttgtgtttttagaggaaaaagagattttggaattaggaagagaagttgttattttagtaaggtttggtagttttttatagtgttgttttttgtggatagagtttgatatgattgtatttggttaaggagaaagatttataaggttttggtttagtattatggagtggggtttggtaggatgtatgtagagttaagaggtaatatatgggtaattggtatatttttttagattttttgttttttttgttgttttgttttgttttgttttgttttgttttgttttgagagagtattttgttttgttgtttaggttggagtgtagtggtatgatttaggtttattgtaatttttattttttgggtttaagttatttttttgttttagttttttaagtagttggagatgtttattatgtttagttaatttttgtatttttagtagagatagggttttattatgttggttaggttggttttgaatttttgattttaggtgatttatttgttttggttttttaaagtgttgggattataggtgtgagttatattgtatttggtttatttttttagatttttaaagtagatttttaggtttttttttttttttttttttttttttttttattttttttttaatataagtatttatagtttttttttaagtattagttttagtttatgtattttagtatgttgtgtttttattattattttatttgaaatattgtaaaattttttttgtgattttttttttgatttatgggttatttagaagtatgttgtttaatttgtaaatagttaaggtttttttgagtattttagagttattgatttttaatttaattttattttggttagataagtatattttgtatgtttttaaaatttgagatttatggtttagaatgtgtattttggtgaatgtattgtttttatttgagaaaaaaatatgtatatatattttagattttttgagtatagagttttataattgttgattaggttaattgttagttattagtgttttttagattatttgatgtttgttttttagatgttgagagaatggtgtttgttatggtttatttgtttgtgttttttaaaatttatatgttggagtttaatttttggtgtagtggtgttgggaattggggtattagggaagtattggtttatgagggtagagttattgtgaatgggattagttttttttgttatgtggggatatagtaggaaaaggatatttttgaagtagggagttagtttttattagatattgagtattttgattttggattttttagtttttagaattgtgagtattataatttgtttataaattatttagtttaaggtattttgttttaatattttgaatgaattgaggtggtgttaaaatttttaattatgtatttaggtgtagtggtttatatttgtaattttagtattttaggaggttaaggtgggtggattatttgaggttaggagtttgagattagtttggataatatggtgaaattttgtttttattaaaaatataaaaattagttgggtgtggtggtaggtttttgtaattttagttatttgggaggttgaggtaggagaattgtttgaatttaggaggtggaggttgtagtgagttgagattgtattattgtattttagtttgggtaataagagtgaaattttgttttaaaaaaaaaaaaaaagagtttttatttatgattgtggaattgtttatttttttttttaatttttttaggttttatattatgtattttgaagtttttttggttaggtgtatatatatttatgattataatggtgttttgatgaattgattatttaattatgatgaatgtatttttttattttgtaataattttattttggatttaattttattgatatttatgtagtttttttagtttttttaaatatgttgtttgggatgtataagaaggttggagaggtttatggagaaatttatgatggtttgatttatagttttttaattttattatggtgtgaatgtggtatgtatatagtagaaattgtattttaagtatgtgtgaaattattgtgttttttatttttagtatagtatttaataatttatatgagatagttaatattttattataaaataggttttgtgtttgttgattttgtttaattgtaggttgaagtaagtgttttaattatgttaaggtaggttaggttaagttagaatgtttggtaagttagatgtattaagtgtatttttgagatgatatttattttttatttatgatgggtttgttaagatataattttattattatttaagtagtattagtatgtttttttttaaatagaaaattttaatttgtgtttatattgaaatagtattttttgtagatagtatatagttgagttttgttattttatttattttgatagtttttgttttttaattggaatatttaggttatttttgtttaatatagttatagatatgattgggtttagagttattattttgttttttgatatttattttttttattttgtttttttggttttttttatgttaattaagtattttttagaattttattttaatttatgttttttttttttttttttttttaagatagagttttattttgttgtttaggttggagtgtaatagtatgattttggtttattgtaatttttgttttttgggtttaagtgatttttttgttttagtttttttagtatattgggattatagatgtttgttattatggttggttaatttttgtatttttagtaaagatggggttttattatgttggttaggttggttttgaatttttgattttaggtgatttgtttattttggttttttaaagtgttgggattataagtgtgagttattgagtttggtttgttttgattttttaattgtatttttttgtattgttattttagtagttattttatagattttattgtatatttttagttttttatagtttatttagaattaatattgtttttttttatggaaaaaaagtgtaagaattaggtaattttatgggtttatttattattttttattttgtatgtgatggttgttagatatttattatatttatatatattgtaaattagataatataataaggaaatttttgttttaaatagttttatgtattttaaagaaattaaaagtaaaatagaattttttttatttgtttatgtatttgttatattttgtgttttttatttttttttgaagagttgagtttttatttggttttattttttatgattttggagaatttgttttatggtttttgtagtgtaggtttgtagatagttaatttttttttatttttatttatttgtaaatttttattttgttgttattttttttttttttatttttatttttatttttgagatagagttttattttgtttttttataggttatagtgtaatggtgtgattttaaaatttttgtttaattttaatttattaattttttttttttgggtttaaatgatttttttgttttagttttttaagtagttgggattataggtatgtgttattatatttagttaatttttgtatttttagtagagatgggattttattatgatggttaggttggttttgaatttttgattttaagtgatttgtttgttttggttttttaaaatgttgggattataggtgtgagttattgtgtttagtttgttgttatttttgaattataattttattggttatagaattttgagttgttagtttttttttttaggattttaaaatatagggttttagtgtttttggtttttgttgtttttgttaaggaattagtatttatttagttatttttttgtagattatatgttgtttttttttggatgtttttaagattttttatttaagtttgattgtttagtatttatttttgggtaaaaaagtttttagaaattagaaatttatttagttttatttttttttgttaggtgtagattttattttagtttttatttatttgagatattttatattgattttaggttgttgttattttgtttttttaaatattttgtttagagttataatgttttttgtagaattgattagatagtagttattttttgtgattaggagttttgattttttagatttgttgatgggtttataaagtttttgtttgtggtttttagttggtagtggtttttttgttttgaagttgttatgagtgtgtaaaatttataggtttaattttttttattagtatagtttagaaaagtggaatttttggtttgggtggttatggtgttttagattattggttagattagggtggtgattgttagttggttgaatgtggggtttttagtttagtatttttggattttattttaggagttatggttgttttagggttaggggtttggttttagtttttgtttttttttttttttttttaagttgtttagtattaggttttaattagtattttttgtagatagggtgggttggttttttattagaggggtagggttgggtgggaagtttgttgagtttttttttttgtgtagtttatagttttggggttagttttagaggggtgtagaaaggagtttttaaaggtagaaatttatttttttttttgtttttgtgtttttagggataaaggagaggtggttttagttggggggttattagtggtatgtaggaggtttatatgattattgtttgttggggtttttttttttttgtgagagagatgagagagaggagagagagtgtgagttagggtagtgtttttttttagtaatgtagatttttgtatgtgttttttaggagaaattttgttatttgttagagttttagatttggaagaagttttgtttttttttttttttttagtgtagtgtgtgtgtgtgtgtgtgtgtgtgtgtttttatatgtattatatttttttatagaggaaataatttttgtttaagtgtaaaggttgggattggagtaggtagtatgtgggttaaaggagtagagaggaggaaatgggggtgggggtgagggtgggaataggaggtgggtagatgttatgaggtatgttttttataattagaagggttggtggagatgattagaatgttttagatagattttttattaaatttttaaaatttaattttgttttatgaagtttgaggattttgtagagtgaaagataaggaagggtttttttgtaggggggtgtgtgtgtttgtgtgtgtttgtgtgttgtgtgtttttatgtgtgtgtatgtgtggatttgtgtggtgtgtgtttgtatatgtgtgtatgtgtggatttgtgtggtgtgtgttgagtgtgtatatgtgtgtgtttgtgtgttgtgtatgtatttgtatatgtgtatatagattttattttttttttttttggtttattaagtgttagaaagaatttttgtgagtttttttattttttttaaggttgtatatggagggatttgtgtaggtatatgtgtgtgtgtatataatatatatatatatatatatatatatatatatatatatatatgagttaggggtgagtatttttgtggattgtatttaggtttggtaggaaattgggttttgggaaattgtaggttttatttttggtagaaaattatgtttttgttgttgtttgttgaagggaatattaagtggggttggggatagtttatgttgagaagagtaaattttgtttatggtattggggatattgagtggtttttgttttgggttttggagggtttgggagatatgtttgtagttttgggtattttttaaggttatgggtggttatatttaaggttaggtttttttttgtgtgagttgtggttagtaggaaggttgattttagaggtggttttagggtttttggaggttttgtttttgagatatgggttaaggttagagagttgagaaggttgttgttgaggattttggttggtgtttagtttagtggttttttaggtgggttttgtgtaggggttgatgaagttagttgggaaatttgtgaaataaagtataggttttttaggtttgtttagagttttggtattagatgaggtgtagagaagggaattgagttgttaagtgtgaataggagagaggagttttaggattatataggggttttgatatggtaggtgtttggttagtagtggtgttgtttttattgttggatgtgggaaaatgtattgatatttgttgattagagttggggtgagtatttgggtgattttgtagatgagataaaataagggttgttgtgggggaggggtttttgttgggttattttgttgaggttttgtgttattgttttgtggttgttataataaaggattataaatgaggtgatttaaaatatttgaaattggttatgtgtggtggtttatgtttgtaattttagtattttgggaggttgaggtggttggattatgaggttaggagattgagattattttggttaatatggtgaaattttgtttttattaaaaatataaaaaaaaaaaaaaaattagttgggtgtggtggtgggtgtttgtagttttagttgtttaggaggttgaggtaggagaatggtatgaattttggaggtggaggttgtagtgagttgagattgtgttattgtattttagtttgggtgatagagtaagattttgttttaaaaataaaaataaaaataaaaataaaaatatttgaaatgttttttttaaagtttttggagttagaaattttagattgaggtgtttgaaggtttattttttttgggggttttgagggagattgttttatgtttttttttgagttttgtggtggttagtaatttttggtattttttggtttgtagtttggtttattttttatttggtttttattttgtgtttttttttgtgtttttgtttaaattgttttttttgttgtttttttaatttatttttagggataggtttttattttgttttttaggttggagtgtagtggtgtgattatggtttattgtagttttagttttttaggtttaagtaatttttttattttagttttttaagtagttgggatataggtgtatgttattatgtttggttaattttttaatttttttgtagagatgagggtttaggttggttttaaatttttgtgtttaggtaatgagattttgttttttaaaatattgggattagagatatgagttgttgtgtttagtttatttttgttttataaagatatttgttattggatttagggtttattttgatttaatatgtttttaaataatttaattatatttttaaagattttatgtttatataaagttatatttataggtattggggggttaggatttgtatatgttttttgggggaatataatttaatttataatgggttttatttatagaatgaatggtttttttagggtgtgtgtaggtgggtgaggggtttaggagagggatttgtgtggtaagagggtttgtgtttatgttagagattttagaaggagattggatggggtggttgtatggagtaaggggttatagttattgtttttaagtagttggtgggttgtttggtagaaagggagtatttattttgagtttttttaagatatgaagttagtattaggtatttggaaggtgttagtgagtagagtttgattttttatagaaagaggtgttttttttataatgtttatttgaggatggtggaataggttattttataaggtagtgagttttttatgtttggaagtatttaagtaggggttatgtgggagttgtttaggagtgtatagaagggattttagaggtttttgttaatattatttttgtttgttttattttatgataatttgaattttagaatgtaatgttattggggatatgtttattagaggggtttttagtattaggttttatatattatgtattatttttagggtagggaatgagagtaggttttattttttttggttgtttgtgaggattaggaggtttgttgttgaggtagttttttgtggaaatagtgttttagttttgtaatttatttattggagttttaatattttaatgaaatattgtgttagatgggttttgggtatgtgtgtgtagattgttataagtttatgagaatgtatatatgtatattgtatgtgtgtgtatatatgtatgtatatatgtataagaatatgaagatttgaggtaggtatagtttgtgagatagatttttttaggttgaaagattttttataagggtttttagaataaggttttagttttggtagttttttttatttttggtgggaggatttttatagagaagaagggttaagaagtatagtttttgatgtttatggtgtattaagttttgttttaagtttgtgttttattttttatttatttagtaaatttgttgtttttgttttgtgttagatgttgtttttagtattttataaatattgatgtatgtttgttttatgataattttgtgaagtaggtagtgttattttgttttatagatgaggaaataggtgtagagggataaagggatttgtttaaggtttgtttttattttatatgtatatgaatgtttatttatgtggtaggtgttagtttttttttgatgtgagttaggttttgagttggttggggtttgggttttattttggttgtgttttgttgtgggtattaaggaagtttttagtagttttatttttttggtatgatttagttttagggattggatttttttaaatgtttttgtttagtttggagttttttttttagttgggggagggttgaatgattttttatttttggaggttgttggagttttttttgtttgtatgtggttgttgttgggtggataggtttgtttgtgggttgaggtttttagtagttggggtggattatttttttttttaagaagttttgggagaagtagttgagggggttagtgtttttttgaggttaattttttgttttttttagtgtaggtgtgaagttatttttgtttgtgtgtttgttatagatagtggagggtggtgtaattgtgatgtttgtttgttgtattttgtgtttttgaggatgttgatttttggttggtgttgggtgtttgttttttagttattttgttttgatttggtgtggtaggtttgagtattgtttttttataaggaaataggtttagaggttttgagttatttgtttgggtttttttagttaataattggttgagttaggatttttatttagttttgtgattttagaagtttaagttttttttattatgttagggttaggaaaggattagaatgtttttttatgtgttgattatttggatgatttgtgtagtttagtttgttgtagttgtttaataaaaatgtggaatgaatgggtttatatgttttattgtgtgatttagagttaatgattttggttgatttttttgtttttattttgtggtttagtatttttttttggggtgtgtgattttggaagtagtgattttttttattttattttgaatggtgtttgtgttgtagtaggggagtagttggggattgttagtgtttgttgttggtgggttgtgtgttagattttgttttggatgtgtgggtgattgttagttatatgtgtgtgaagggttgtgtgtgtaggatttgtgtaaatgtgtttttttttgttgttagtttatgggaggttgttaagattttgtttttgtatattagtttatattttttttgtggtttattgttgtggttgtttttttgtgttatgtggttgtaggtatagtttttaagtggatggggattgtgggttgaatgtgtattagatgtttttgttttttggtgggtggagatttttaatttatgtattgtggttgttgtatttgaaaggttttttatggtgaaggatttggatttgagtaattttttgtagaggttttagaagtgttttttggttgggtgtggtggtttatatttgtaattttagtattttgggaggttgaggtgggtggattataaggttaggagattgagattattttggttaatatggtgaaattttgtttttattaaaaatataaaaaattagttgggtgtggtggtgggtgtttgtagttttagttatttgggaggttgaggtaggagaatggtgtgaatttaggaggtggagtttgtagtgagttgagattgtgttattgtattttagtttgggtgatagagtgagattttgttttaaaaaaaaaaaaaaaatgaagtgtttttagtttttttttttgtggtgaggttttgagtttttatttttagaagaaaatttggttggggagggtatttttagatttggatataaatgttaggagattagggttgtttttttaggtgattaattatagagatttagggaaagttatgtttggaagaggtgatattgtgttttagttttatttatttttttattttatagatattgtttggtgtttagtttgtattgtgaggttttttaagtagttttgggtattgtgtatttggtatggtttttagttttatttttttgttttgggagatttggtggggattttgggttgagtttttgtggttgtggaattttggtggtttattgtggtggttgagaatagggatgtggggttggatgggttgagtgtaatttttagtggttttgtgaattgtttgggagttttgggtagtttttttttattttgtgtttttgttttttgatggaaaaatgggggttaggggggagtgattttgaaggtatttgtgggaattaagtgaggtgataaatgtagtgtttttggtagagaattggatatagagtttatttttatgaagggggttgttttttttttttttatgtttttttttgtttttatttttttttttgtattttttttttttgtttttttttttttttttttttttttttatatgtaggtatattttatttggtgttttaattgtttttttttattgtttttttgtaagtggttttttaagtgggaatttaggtttggaaagggtgggtattttgtttggtgggttttggtaggttaggtgttgagtagttttaggagatataattttaggaaaaggtttatgtaggttggttgttatgatggattgttggtgggagaggggaaggtgttgtggtaggggaagttttggaaatatttattagtggttttatttatgatttaggatatttgttaggttattagaatatagttgaggaagttgttggttagatgtttagaagtattaatttggtggttgggttgtggggggatttttttggataggtagataaggtgttggaggaaggggttgatatttatttagtgtttgttatgtattgagggtataaagggtaggatggagagttggtttatgttatttgtggaattttttaggtgtgggggtagatggggaagtaagggggtttgaagatatatgtgtttattaaatgtttttaaattttaagaagaagaataaggatatatttataggggtagggttgaaagtttgatgtatggtgttttggggtttgtttttgttgtaatagttatagtggtttttttttattttttttttttttttattttgttgtgaaaatgtttaaaatatatggttaagttgaaagtattttatagggaatatatttagttattatttagattttattattaatattaagttatatttgttttattattttattgtttatttattttttttttgtttggttatgaatttattttatttttattttttggtgtattttaaagtaattttaggttattttgattatttttggaattattgttagaaatttttttttttttttttttttttttttttttttttttttttgagatgggattttgttaggttatttaggttgaagtgtggtggtgtagttatagtatattgtagtttttaatttttgagtttaagtaatttttttgttttagttttttgagtagttgggattgtaggtatttattattatatttagttttatttttaaaattttttattaattttttattttttgtatttatttaggattattttttataaagttagggtgttgtaggaggggttagaattttaagttttaattttggttttgttattaatattgtgtgatttttagtaaattattttgtttgtttaggttttgtttttatttttatgaaatgagggtgttaaattgtatgttataaataatgagggttattagttattaagtttttattttaggttaggtattttttatatgttattatgagtttttttaatttaggtattgtttttaatggatagtttagttaatggaagtttagagaggtggtgtaatttgttaaaagttttattatttagtgaatgtttttatggggtttgtatttaggagtttgatatagagtttaggttttagtatttggtgatgttttgggggtgtgagtagtttagtttattttgggtatgtgtttatttgttgttttttttgttttatgtttgtgtttgttttttttgaagtttagattgttattttttagttttaaatattaaaattggttaggtatggtggtttatgtttgtaattttagtattttgggagattaaggtgggtggattatttgaagttaggagtttaagattagtttggttaatatggtaaaattttatttttataaaaaatataaaaattagttagatatggtggtgtgtatttgtagttttagttatttaaggagaatttagttatttagttattgaggtatgagaattatttaaatttgggaggtggaggttgtagtgagttgagattgtattatttttttttaggttaggtaataagtgtgagattttgttttaaaaataataaataaataaaataaaataaaaattaaaattaaatgttaaaattaatttataaaataaattttggttaaagtagtttgtttattttgttttaattatgtatattgtattagattttgttaggggtttagtgtataaagatgagatttttgttttgttagataggtgggatgatggttatattttgagttagttaaggtattatttggttgtgtaataaaagttaaaatattagaggttgagtagtatttggatttatgttttagtttaagtgttagttgttatgggggtttaggatagtttggatttagtttatttttttggtgtatttttgatatatagtttttattttttgagttgagatggttttagtttttgttgttatgtttgtattttagttagagggaagggaagaagggagaggggaaagggtaagtgtttttttttatttttaagggtatgatttgaaagttaaatattttagtttttttttattggttagaatttagttgtatggttgtttttgttattagggaggttgagtaatgtattttttagttgggtttttttgtgtataattaaaattttagttattatagaaaaaagggagtttagatattggggaaataattagtatttgtattatatgtattgatagttttttttgtatgaatagagttgtggtaggttttatgttagggagaaagtaagattggaaaagagtttattaaggaggtggtatttgtattgtgtttaaggggtaagaaaaatgttttttaattaggagttataaatgtttggttgaagtgttattgtttttttattttggagttggaatagatgttattagttaattatgatggttgttgggtgtattggttaatatttataattttagtattttgtgaggttgagggtgggaagattgtttggggttaggagtttgagattagtttgggtaaattgtaagattttgtttttgtaaaaaaatataaaatgtagttgagtgtggtggtatttgtagatttagttttagttatttgagaggttgagatgggaggattgtttgggtttaggagtttgaggttgtagtgagttatgattgtattattgtattttagtttgggtgatagagtaggatttgtttttaaaaataataaaataaaattaaagttttaaaatggaaaaaaaattatgagtatataattttagatgtatttttaagatagtaaatttgggtgggtgtagtggtttatgtttgtaattttggtattttgggaggttaaggtgggtggattatttgaggttaggagtttgagattagtttggttaatagttttatttgtattataaatataaaattagttgggtatggtggtgggtatttgtgattttagttatttggaaggttgaggtaggagaattgtttgaatttaggaggtggaggttgtagtgagttaagattatattattgtattttagtttggagaaaaaaagtaaaattttgttttaaaaaaaaaaaaaaaaagtaaatttagggttaggtttgtagttatatggttatttttttttttgagtatggaggtagttttagaaatttgttttatattatattagtgggtagttgattgggttagtttgttagttgaattttatttgttatagttattttttatagtaaggggtattttagatatatttttttttttagggaagaataagttgtagttgtttgagtgttttatttagtggtgtgtatgtttttttttaattttgtgtttagtgatgttttgtttgtagtttgaaatttgttatagtgggtgtgtttatattataggaattggtaaatattatatattaggttttattttttgttttttattagggtaggttgttttttttttgttgtttttgttttttgtttttttttttttttgagatggagttttgttttgttgtttaggttggtgtggagtgatgtgatttttgtttattgtaagttttgtttttttggtttatattatttttttgtttgagtttttagaatagttgggattataggtgtttgttattatatttggttaattttttgtatttttagtagagatggggttttattgtgttagttaggatggttttgattttttgattttgtaatttgttttttttggttttttaaaatgttggtattatgttattgtgtttggtttagggtaggttgttagaaatgtattagtttgttagttttagttttgtttgttttttattttttttttttttttttttttttttgagatggggtttttttttgttgttttttaggttggagtgtagtggtgtgattttggtttattgtaatttttgttttttgggattaagtgatttttttgttttagttttttaagtagttgggattataggtgtttattattatgtttagttaaattttgtatttttagtagagatggggttttattatattggttaggttggtattgaattttttatttaaggtgatttatttgttttggttttttaaagtgttgggattataggtgtgagttattgtattgggttttttttgtttttttttaatgaaaatttttttgaaagatttgtttattgatgtttgtgttaataggtattgtttgtgggatagagtttgttttttttttgaaggtttttttttgtttgggtgattatttgtatgttattttttgttgtttagaattaaagatgtagttatgtttggggtaggttgggaaaatttgtgggaattatagagtttgttgttatgttgtgttttggatatttgaagtttggtaggtaggtgggattgagggtgggtattaggaaagtgatgtggttttataggaaggggatataggttttgagattttaggtttttaattggataaagttgttttttttttttggataaatgttttagtttatttataattgagtggttagtttttttttttttttttttttttttttttttgagatggagttttgtttttttgtttaggttggagtgtagtggtgttattttggtttattgtaagttttgttttttaggtttatgttatttttttgttttagtttttggagtagttgggattataggtgtttgttattgtgtttggttaattttttgtatttttagtagagatagggttttattgtgttagttaggatggttttgattttttgattttgtgatttgtttgttttggttttttaaagtgttgggattataggtgtgagttattgtgtttggttaagtggttagtttttttagttgttgggttttgtatattttgttggttttggagattatatgtattatgtagattttatttgttttttatttttagtgttgggggaggggttaagggtttgttgatgtgttgatatttggttatttattggttttgaatgtttatatttatttttttgaaattgatgttttgtattggaggttttatgtggatttgggggtagaggtttgtattttagatggtggggtggtttttattaattaggtagattttttgttttgttttgttttttgggttttgtagttttagatgtgtgtttaagatttgtggttatatggatgggataagttatagagatttagattttgtggtttttgtgattagagtagttgtggttttgtttgggaatgtttttattttgttgttgaaggtgagaaatttttttgtgttggagaatagttgtgttgagaagttggtttatttggtttgtaggattgttggggtaagggaggtttgttgttggttttttttttttttttttgattgggtgttttttgtttaggttttttgtagtaaaagaattttttaatttattttgtttttttattgagtttttattttatgaagtttattttttaattttagttgattggtttttatttttttaagaggaaggttaggggtagatgaggttgaaggaggttgatttttttgtgtttttgtagtttgagttgatgttgttgtatgtttatagggtttttttagtttttaaaaaggttttaatatgtttgttatatgtttgtggtttttttggatgttatattaatttagtaaggtttgagttagaggttgtttttgaggttgtgaaaatagaagaagggtttagaggagaatttttttatttgatgattttaggaaggttttttagaagaagtagtttttgagttgagatttgaagatagattaggtttgagttaggttagggagggtgtgaggggtttattaggtagagggaataggatagggtaggtatagaggtttggtatttggtttgtggggaagtgtgagtttttgggtatgattaaggtggggagaagtggtgtgagaggaggtagatgtggttggtaggagattggtggttttggttttgttgagttttattttgtatgtattaggtgatagaggttgtttaggatggtgggtagggaagtgataggttatatggttattttattaatagttgggagtttagtttggggggatttaagattttggggaaggtatgagttaggggtttgttagagttaggagttagtgggagaaggaaatagtgttgtttatgaattataaatagatatttttgtaattttttttgatgtgatataattttaaagtgggttatttagaggtgggaaggtgatttttggttttttaggttttgggtttgttttttttttttttttttttttttttttgagatggagttttattttgttgtttaggttggagtgtagtggtgtaattttggtttattattatttttgttttttgtgtttaagtaatttttttgttttagttttttgagtagttgggattataggtatttgttattatatttggttaatttttgtatttttagtagagatggtgttttattatgttggttaggttggttttgaatttttgattttaggtgatttgtttattttggttttttaaagtgttgggattataggtatgagttattgtgtttagttgagtttatttttaagttttttttggtttttagtgtttttgtattagtttatttttttggttttttgtttttaagagttttttttaagattgtttttaagtggataggtttttagaattaaggagtagttttaggagtttttagttatagatattttagggggtttgtgtggtttttagtttttggtttggttttggtagttttggttttttgtgttgttttttatatagtttggttagagttggttaggttttttggttgggttgagttattgtggttagtgatttatgtagggggagaaaagtgaggagggggaatagagtgtgagggggattgtgttaataataaatttattaggtttttgaggttattttataggagggataaatggtttatttaggttgatttggttgttggttggtttttagagatatttagggtggggaagattttattatttggggaaagtaatattagattgtttggaggggtttagttagtgtattttgtgttttttgtttgttttttatgtagagtgttttgtttttaaggtggtaggttaagagtgtgagttgaggtttaggtgtaaagaggggtgtggtatgggggtattgtagggtatggggtgtatgtatttttatttatttttttattgagtgttagggtaatttgttaatggggtatatttggtgatataaaattttttgttgatttatggtagtttggaatggagtggaagtgttttatttttggggaatttttatatatatttggttgtgaatgttggtgtttttgtattggagtttttttggagtgtgttgggtagagtggagaggtttttttttttttttttttattattttgtggaggtgttaatatgtagttagagatggttagtggtagtgaggagaggggggtaggaagagattagggttgggggtttgttagtttatagttttatttttgaatatttatggtttttttgtttaggttagtgaggttgggggtagagatgggtaggggttttttaatgttgggtatttttttgtttttttatattttggatttgttttttggagaaagttttggagtatttagaagttttggggttgttggttgaggtggggagtagagtttagttgtgtttggaggttttttatttttatttagtttttagggatagttttagttgtgtaggtttaggttgttgaggttggttttagaaatttttttataattattattggatggaaaattagttttttaaagggttttagagttagttttgtttttttttttataggtttttatagttagagtattgggtttttgttagagatgtagaagagatgatgtttttagtttttatgtggtttggtttttattgtggatgttggtgattttagttttttttttaaaattaagagggttgatgttttatattttaggtttttagaaagagttgttatttatttatattgttatattttttttttatttttttgttttggaaagagtagagtggatatgtgtttttgtagaaatttatttatagtttgattgtagatgtattttgtttttttattgagtttttgttttatgaagtttgttttgtttgtattttttttttttttttttttttttttttttttttttttttttttttttgtttttttttttttttttttttttttgttttattttttttttttttttttttttttttttttttttttttttttttttttgttttttttattttttttttttttttttttttttttttttgaatagttaaagatagaatgaatggtataggtaggtattgagttttttgtaattggaggtgtttaagtgtagggtggatgggtatttatagggtaggtattgaggaaggatttttttgggattgtggatggtaggataggttttgtggagttttttgagtgggtgtagaagagggagggtatgtttttgttttttgttttttttgggttgttaggttgttatttttaatttttattttttttttttttatttgttgggttttatgggatgggtagaggtattgttagaatatggagttgtggtttatagagggttagtagggaggagagttttttggggattatgttgttttagttattgtggtgattttgaaaataaatgtttttttttttgtttgagtttttgttgtttttgttgatgtggaattagggtaggttggtgatttagtttttatttttgtattgtattggtggtaagttgtttttagttttagattttatagagtagggtgttttttttagaaaaatagtagggaggttaggatattaagggttttagggatagtttgttttttttggttggtatgagttttagttaagttttttggtattttgggggtgaggaggtattagttgtgtgttttagttattggttgttttgaggttgggttggtgttaggttggttatttttttttgttttttagtgtgattttgtagagtttttggaagggttagagggtttttttttattattggtgtttatgggatattgtgtttttattttatttttgtattttagttttagatgggtgttaggaagttggagattttagttattttatgattgtgttttgtggggttggagtaggaataggagtaggaggaatgttttggttatgggattgtgtgaagagagaaggattaggaagaaaatatgagttattatgtttgggttatattttagtagagttgttggtggttttttaggtatttgaatttattaattataaagtttattaggtgtgtaaataaataaatgttgtttaggaggtatagttagggttttgttggagagggattattttggaggggttatattttttatttagttttttagtttttttgttttgtgtgtgtgtagtttttgattattattatttttgtttttgttatttgtttttagggttttattaggttggatgttattgtaataaaatgtagtaatagaaggtttaggtagtgttgtagtttttggtggtattattagagttagtaggtagtagggttggggaattttaagttgatttagttttaagtgttggagtggggagtttggatgaggtgggggtggggaattggggagttatggagtagagtatttgttgtgttgaaggttaggagtttttttgggagattatgaatttagaatattaatattttgtttaaaaagttttttgttttggagataagagtttaggttgttgtggttaggttttgttgtaaatgttttgtataaagtaggttggggggattattgggaagtttggggaatagattggttatgtgtttttttgagtgaaattttatggttgtattgaagtggttaggtagagggtgtgatggggtgtggtagttgtatattggtttagttaggttgaatggggaaatgtaaatttaggtggtttgaaagagatttagtggtttatagtttggtggttgtttttagtataggtgatgtaaagagagaaggggttttgggggtttggtttaggtggaaattatgtattgtttgtgattttgggtatgttgaggttggagtaggtttgtttggtggttggtagaatgtatatgaagaatttatgtgtgttttgaatgttttttttgtttttttgggtttatgttttattaggagttttttgattttgttattttgtaaaggaaattgtgttttgttattgtataggattgaataggtgtgtgtggagtttttaaagttattgttttaaggggttttatgggataatgggagagttgttgtgatgtttaagattaaagtgatggttgggtgtagtggtttatgtttgtaattttagtattttgggaggttgaggaggatggattatttgaggttaggagtttgagattattttggttaatatggtgaaattttatttttattaaaaaaataaaaattagttgggtatggtagtgggtgtttgtaattttagttatttgggaggttgaggtaggagaattgttttgatttgggaggtggaggttgtagtgagttgagattatgttattatattatagtttgggtgatagagtgagattgtttaaaataataataatgttaataataaataaaataataataataaaataataaaagtaaggatttgaataaatatttgtatatttatgtttgtagtagttttatttttaattgtttaaatgtggaaggaatggatatataaagtgtgtgtatatatagtggaatattatttagtttttaaaaggaatggaattttgttattatatgtgaattttgaataatgaattttgaagattttatgttatgtaagtttgttttataaggataaatattgtatgattttatttatgtgaagttaaatttatagagaaattggaatgatggttgttagtagttaggggaaggaaggatggggagttattgtttaatgaggatagagttttagtttgggaagttggaagaagttttggaggtggatggtgttgatgggtgtataatgtgaatgtatttaatgttattaatatggaaatttggttaaaatggtaaatttgttttttttgtttttgttttttttttttttgagatggagttttgttttgttgtttaggttggagtgtattggtgtgattttggtttattgtaatttttgttttttaggtttaggtgatttttgtgttttagttttttagagagttgggattataggtgtttgttattatgtttggttgatttttgtatttttagtagagatagggttttattatgttggttaggttggttttgaatttttgattttaggtgatttatttattttggttttttaaagtgttgggattataggtgtgagttatggtggttggttaaaaatggtaaattttatattatatatattttattatagtaaaaatgtattgttttattagaaaaatgatagatttttataatatgaattaaattataagttatgaaggaaaaattaagtaaaatattaaaaaattatttataagtaattatatttaaaataaaagataataaatatataatttttattattttttaggttttttgtaatatttaattattgtttgttttgttgtggttatgtttttgaggttgtatttgtatgatagaaatattatatttgtggtgattaaatatttttttttagttttatttttaatgatgttatatagataatttgaaattggttggttgggtatgatggtttatgtttgtaattttagtattttgggaggttaaggtaggtagattatttgagtttaaaattagtttggttagtagggtgaatttttatttttagtaaaaatataaaaattagttaggagtggtggtgggtgtttgtaatttgagttatttgggaggttgaggtaggagaattatttgaatttgggaggtggagtttgtagtgagttaggattgttttattgtattttagattgggtgatagagtgagattttgttaaaaaagaaaagaaaagaaagaaattggttaaggtaggaatattgatattataggaataggtaagtgttataaattgggaaattgagtgttgttgtttttgttggttttaggtggttggttgttgattgttaattggtatattattggaggagggaggtttagattgatttgtagagagattagaggtagaaatgtattatggtttggatgttgagggtgagggaaagagaggagttaatagtggtgtttggagatttggtttgagtaattaggtggatggtagtattgttttttaagatgaggggttgtgggaatttgaggggttgtggaaggttttgttattgatggatttagggtttggtagttttgggaggtttattttgtgttaggttatgtagagataagattatttgggttttgtttttgggaagtttttgtttatgaggatatagtttgttatttaatggggtgttttgtttggagttttagtgttgttgggagaaagttttttatttttttttgttttttgagttttttttgtttttttgttagttgagtttttttatggaggttgtgtttggaggggggttatggatatggatgtgtgtgttaaatgttgtttttttgtggattttttttttattttgtttttatgttttgtaagttttatttttttggggtttgatttgtggggtttttttttagatttgtttttttttatttttagaaaggtgtgtaggggttttttatggtttttttttttgtttttatttttttttttttgggatagtgatttgttggatgggtgggttatttatagggtttgtgattgtttagatatttttgttgtatgaagttttgattttaaggtatgatgtagatgggaataaggtatgagttttttttggttgttgtaataattgttgaaattgggtggtttatagtaaggggaatgtgtttttttatagttttggaggttagaagtttgaaattaaggtgttagtagggttagttttttttgaagattttaggggaaaatttttttttgttttttttagtttttggtggttttaggtgttttttggtttgtggttgtattattttggtttttgtttttgtttttataaggtttttttttgtgtttttgtatttttttttttgttttttagaaggatatagtattgaatttagggtttattttattttgagatttttgtttaaattttttttgtagagatttttaaatagaattaggttatatttgaggttttaagtgggtatatttttgttttgggggggattattggtttattgtaggttttgttgtgtattgaagatgtaggtggtttttttggttaggtttgtagttggttttgtttttttttgtgattgtggaagaatgtattttgttggatgtataggtttttatagtttttttgtttttgttaaattttagtttagttttttttttgttgttggtgtgtattttttttgtttagtgttttttttgggattgtgtgtttaggttttgaggttttagaaaaggggggtggagggtttttttattattttgtagtaatgaggttttattaaaattttggagttttagattggatttagtttttagttatgattaaaggatagtttgggatatgattaaagggttagagaaagatgatttaggttgagaaagaggaggttaaggagtaattggattgtttttgaatgtggaaaaggtaattatgatttgaagggtggtgtttagttgttttttattttttttgaggataggaaaaaaaaggaaataaatgatgtataattagagtagttggttagatatgagggtgaattttttggttgggagtatggttaagttttgatttgggttttttgaaagagtttggggaatttttttatttggaggtttttaggtttggttatgtggttttgagtgattatattgaaggggtagtggttggggttggagttggtgggttttgagtatagttatgaaggtatgtgtattttttggttgtttttttgttattgttttttgggtttttattttggtgaggtgtgtattttggtggtgttttttagggaattaaatatgtttgttgtattgtgtgtggagatggagaatgtataattggttgattttgtgttaatttggtggaattttatgttagttttgggaaagaataattgtatgggtgtgtttatatttattaggtgttttttagaaaaatatttgagaataatgttgtggtttaggatggttgttgtgttggatttggtatttttttaggggggttgtgttgttgggttgagttttttaggtattggatttttaaatttttaaatatggtgtggataggtggtttagtaggggttggattatttgataggtttaggtgttggagtttagataagatatattttggtttggtgtggaagatatggggtgttattaatggtagtaatggttgtatttttgaaatttgggtttttaggttgatgagggtgtgtatgtatttgaaatgtttgtggttttgtagtttttatgtttataaatttatttggttgaaaatagtttaaaatatttaaagtatgagggagggagtgtttgttttttttaaaaaggaaggatttgattttatttatttaaaaagttatttaaatttagaatattttttgtaagagattttttgttttttgtttttttagaatggttggagagttttagtatttttgtatatttgggatattttagagggggtggggaggggtaagtgggtagtgagtgattttagatttaggatgagttgttaggtgttttttggttatatatttaagggattggagtgtagttgtagtgttgtggtttgttgttttgggggtgggggtgttgttttatgttgtgaatttttatatggtttttgattttgggtagaggttgagggtttaagggatggggtgatagggagagtatgtaggagtgggtttttggttttttagggtgagtggaagaagtgttttttttttttgtaggtgatagatttggggggttttttttgaggatgagagtttgttgttttttaagttttgtgtttaatttaggtttttaggtttattttagttttttggttttgtttgttttgtggatgatatagtttaagggtagagattgttggtttggagggaaggttaggttttaggttagggtttagaagggagggagaagtttttggggtagttttttttttgtttatttattgtttagtttttttttttatatttttttttggaaatgtttgtttttgataaggtttattttttgtttttaggaggtttttattgtggaggaagggaggtgttgtttgtttttggtttttttgatagttgtgttttatttttgttttgtgtttttttttttggatagtgttttttttagggtttatttaggagggtgtagtggtggtttttggggtggtggttgtggtgggggtgttagttgtaggggtgtttttggtgggtgggagttggtggttttttgttggtgttatgggatttgtatgtttgttttgtgttttttggtttttgagtttataggttgggattttgtttgttagttgtgtgtgttgttgtttaatttttgtaggtgtagagtgtgtggtggtggtgatagagaattttgtttggttgtttaaatatagttttttgtagaaggattttgtgtttggggaaggggaggaatttttttttttttgggtgtttgttttttttgttatggtttggtttttatatttgtttatatttggttgtagtggggtgtttggggggaggggttgaggttgtgttttttgttgttttttgggtgtgggttaggtggggaggaggggggtgttttggttgtgtgtttaggattgttttttagtggttatttgggttttagttttttaggtttggttttgataggtgggtggagtagttagtgtgagatagggaggttggtgtgggtgtgggaatttgatttgtttgggaggtgggggtggggtgggggtgtagtgtgtggggaggggttggtgtttgttttttttttttatttatttagttgagttagggggtttaggggtttttttggtggttagttttgtattgtaggagtgtgggtgtggtgttttagttagtgtgtagggtttgggttttgttgggggtgtttttttgttgttgttttttgtgtgatttgttgtttattagttattatgttggattttgtggttaatgtgtagttggatgggattattttggattttgaaggtgggtgttgggttggttgttgtggttgtggatgtgttggagaggattttgtgggtgggtttggtgtgggatgggggtgtgttgaggggagatgggagtgtgttgaggggagatgggatttttaatttaggtgtttttttgttgagagtgttgtgtgtttttggttttgtgtttgtgttgtttatgtgggggattttgttaggggtatttgtgtagattttgtgtgtttttataggattttgtgtttgttttgtgtattgttgtttgggtttttttttttttattgttgtttgtgtttgttaagtgatagtgatttttttgagggtttgtgaggttgttttggaattttttaggatgtatagttttattttgggaaatttattggttttttttttttggttttttttggtggtttttgggttttgtttggatttggtaatgggatagggaggttgttttttatttttgattgagtggatagttgtgttttgtttgggtggatagttttttttttttttatgttagttttggggttgttaagttgtgtagtttgtgggttgggagtattgaatggatatagtttaggttgtggtagggtttagagtgggatgttttatggtttttatttaggtttggggatatttttatttgttttttagaattgggttgtgggggatagaaggggtttgtgtgtgggtagggagagtattttggtttttttttgtttttggggtttataaagtgtgttgggatttgtggggttgttttgtttaagtttgggtttggtgtttgtgtttttgagtttgtgagtgtgtgtgtttttttgtgtttttttgattgttggtgttggggttttgtgttttgtgtttgtgggagtaaatatagtaggtgaaggggaagtttatataatggtttttagtgttttggggtagggtttttgaggggtgggtttgtttttgttgggatttggagtttttgttttttggagaggtttttaggttgatttgggtagagttttttggtgggttgggagggggaaaggttgtgttgaaatgagtaaattgtttaggtgttaggttaagttgggaggtgattagtttgaggttttttttgttttatggttagaattagggttgatatttgggtgttttgagtttagttgtttatatggtttatttggggttagttttatttgagtgggggaggtggggttttttgggggattagaattttggttggatgttaagtagagtgttagtggttgttttttagggttgggtttgaggagggtgtggggtggtgaagggatgggagggggttgtgatttagtggttattggtgttgtgtagagtgtgagttggaaatattgtagttattttgttagtttagtggtgaaagtttttttttaggttttatttttttgtatttttgttttttagagggaggggaggtttgggtttgtagagttgggagggtttgttgtttttgttttttttttttataatatttttttatttggatatttttgggtatatgtttatattggggtttttttaggtttattgtgttttgttgagttttttgtagtttttgagtgaatgtgatttttttgtttttgtttttttgtaatttttttttgtgattgtttttttaggggttttttttgttttaaatgtttaagtggtatgatttagttggtttgattattttttagtaagtttttatggagagaggttttgtgttgtgtagagttttttttttgtttgtgggattgaggtttttgtttttagtttttaatagaaagtgttgggtttttagtgggatttttggggaagaatttttgtgttttaatgggagttttgtggtgggaggggaggttagggtttggggttgtgtttgttgtatagttgttattatttgtattatgaaagttgttagtgttttttttttgggtttttgggtgtaattttatttttgtttttatgtgtttttatttggagttgtttttgtggttgttttttaagttagttttgtgattttgtaatttagtttaagataatgggtttattgagattattttggtgtagtagttggtaattttttggttttgggggaaggttttttagttttggggagtggggttttaatttgttggttttttgtgtttattagttttttttttgtgtgttttgaatggttttgttgggaattttggttttagagttattaggtggtttgagttgataggtgtgagagagtgtgtgtgtgtatgagtgtgtatgtgtatgggggttgatttggggtatggaaaggtggttttttttggtgtttaaggagtttggagtatagttggagggtgtgggggtgtgtatatgggagttggataattttgggtggatagatagatgtggggaagggatgattgaaggaggtggaggagagagtgtgatttagtttagttaggggtgatgtggataggtagtttttgaattagggtagagaaaagttattattagttagtaggggagaagttagtatggaggaggtggattttgagggagagtaggaattggattgtaagaggaaggagagttttttggttagtagtagttagtagtagtgggggaggttggaatgagttggttggagagggggttggggtataaggaggggtttgtttgtgaagattatatgggttaggttgtggagggttaggtatgtttgttgggagtgtagttggtttatgggaagtatttggagtggttgggaatgggtgtaggagtagtgttgtgggagtataggttttttttttggggtggtttatttggtgttttggtttttgtaaggtaggttgaaagggtggggaggaaattgttagttttttatagtgttgggatggtggttttagggtttttgaggttagtggatgtgggtgtttgttattatgtgggttgttgaggggtggagattttaggggttattttaaagtaggatgagttttgagttatggtatttttgggggtagttttttaattgagtagatgtttaggtttggaattttgtaatagaggttatagggttttgattagggtgttttgggaggtttagaattagtggtagtatatagggtagatggtaagtgatttggtatggggaaagaggtaggtgtttaggttggtatagtatatttgtaaggaataggtagatgggaagttgtttgtgggtttgtgtgtgtgtttggagttaaaattttgttaatgttttatgttttgggtatatttattttttttttggggagtatttttttttttattttttttttttttgtttgttttttttatttagggttttttttattttttttgttttggggattgagggtattatggttttatgttttattattgatgagttgtatagggatttagtttttttgttgtttaggttgggttttttaggtttagggtttttaggaatggagagggtattagtgttttttatggatttaaattttttgtattttgtttttgttttttttttaagataggtttttgagttttaaggttttagggttttgtggaggttgttatgtagtagtaaggagaatgttttgtatttggttgatgagatttttagagttttattttttatttttttattgtataaatgggtttttaggtgattgtagtatttgttattgtttgtaatagggtgataagagggatgattttttttttttttttttttttggttggtggaggtatggggttggtggatggtatgtgtttttgtgaatttaggttaaatttgttattgtaaatatgattataatttgggtttttgtgtaataaaagtttttttaagtattagttgttggtttgttttgtttagtggtgtttgttgtaattagatttgtatattgagaaagaatttaaaagtttttgatgtttgttgaaataatttggtttaggatttatgtgtttagattttagagttgtgtggtatttgagttttttttgagtttttattgttgtttgaggaggatttttagatttgtgttttggaggtagagtaggttgtgggatgggtttttgggtgggaaggattatgtggatatgtttttttgtttgagagttttaatatttttgggatgtgggagttggtgtgttggtaggatttaggtgttttttttttttttagagaaaaaggttttgttgtttggtaataggtgtagatttgtttttaattaatgttagtaggttttttgtgtgatgaattttgttttttagttaagatttaaggtattttgtgaatattgtttttttgtagtttgagtttttgtggtgggaggtaggagttatggggagtgggggtaggttttttatatgggttttatagttattggtagtattgatttgatgttttttgagtttagagtttagggttagatagatttattgttttgattatgagttggtttatttagaggggggtggatatagtatttaggtagtagatgtattgtgattagttttgtagtggggttgtgggttttttgggttggatgtttgggaagaggtaggtggaggtaaatgttaggatatttttgtagtgattgggtgattgtaggttggaaatgttttttgtgggttgtggttgtttaggaaggttttgaatggggttagtggatagagtttgtatttagaggggtagtgttttggaggagtgaggggtatggtagtgtagggatgtttaggttgtttttattttgttattggaaagttgggtggttttggtttttttagtttttttgtttgtttttttgtttgtaaagtggggttagaaatagttttttttgagggttgttgggggattttgagatgtagtttatggtgttgagtatgggttttgttttttatgggtgtggtgggtgttgtggttggtgtggtatttgggtgggaaaagggggtatttgtaaaggataggtaggtttggatgtttaaatatgtagatttggggatgggaggttttaggtaagggtttgtgtgatgttattgtatgaatgaggttggatagtatggttattattaattatggaaagtatggtagatattagtgttagtagtgtttgtttgggggtttttttgagtttgataggtatttaggtttttagtgtagttatgggatttttttttttttgtttggttgatattttggaggttggtgttatgttggttgtaggttttttttattgggaggttgttttggttttttttgttattatttatttttatttttattttggagtgttatagatgggtggattatatgtttatttgtagggttaagtgttgataatgaggtgagtatttgttggatgattggattatgaggatagtgggggtgttggtagtttgtgtttggttttgtaggttggtttttttttgaaaagtggttgtggtagagtgtgtattttagggagtggtgtttgttgttttgaatatttttatttagtaggtttttgtaagggtttagttaagtgtggtgtagagttgggttggtagttggaatagttttattttgtttagtggtgagattaagggttgatgggttaaggttgtgtgttgtttgtttagtttgtggatttatttattgagtatttttatatttttatattgggtttggggtgttaggaggtggaggggggattgggtgtttggaaaaataagtttattgagagtttgagtttttaggggttagtattaggtagttattatggtgtttggtatatagtggttatttggttttgttggttgttttggtggtggagagtgtgtatggtggttgtatgtgatgggtattatttagggtaatatagatatgtagattgtgtatttgtttgtaggagttagggattttttagtttggtaatttgtgatttttgtttatttgttgggagagaggtgttgttttttgatagtttggtgttgggagagtagaattagggttttttttttttttttttattttttattttttatatgtttaggtattaggggaggttatatttagggatgagttttggttattgggtttagggttttattgttgttattttttttttttgttagttagttaaatgtttgtttattattgtgttggggatggggttggtttgtttttttgaagtttttttggtgtatagtttaggttggagttttggatgattttgttatttttttttttgattttttttttttattttgatttattttagaaatttagttaaaaattaagtttttgtgtttttttttgataaagttattgaggaaaaatggttaaatattgtttttttttttaaagtttttttggttttttttaaatttggaggttttgagttgtttatgagattaaagggtttggaattttttggaatatagttttagaagtgggaggatttgttatttttttagttaaatagatttattagttggtttttagatatttttaggtgtttggggtatttttgggtttaggttgtttaatttggtttgtagagttttgaggttttgtttagattgggttagtagatagttttagagattttaagtttgttgttgtttttaaaagttttgttaatgtttagaaatttagagggataagaagatgattttgatgttagttgggattataaatagtgaggtttgtttttttttttatttatgtttgtttttattgtttttgtagttgggtttttaggggattgtttgtggttatgggggaggttgggaatgtggggtttagattttattgggttttttgtatttttttgtttttttttgtttatttttttttttggaaatttttgaatatttttttatagtttttggtattttgttatttttggtatttttgggttaattgggaaagttattatttgtttaatatttagaaaattaaggggtttggttttaaatatattgtagtgtttttttttttatatggtattgaattttttgtgtttttaaagttaggagtttgtgttttggatgtgggtgatggagttttgtagatatttggagtggtttttttgggagagttttttttgtttttttatttatttgtttttttttttttgttttaagttttggttatagttttggaggggttatttgagtgtaggttgtttttaggtgtatagttggaggggggtagttattttatatttttttgtttgttaggggtatttttagggatttaggttttgagggatagtggaagggtggggtggggagtaggttgttgttttgtgttatttgggtgttatgtagattttgaatgggtagtttttgggagttggttttttttttttattttttttatagtgttgtttttttgaggggttggagttttttggagttttttgtagtttgtggtaggtttttttgattttgtgtttggttttgtagtttttaatttatagttagtggtatgaagaatatttttggttgtttttatttgtggtttttgtaggtagtagttttttggggtagggtttgggggttttggtatttttttgtgggattttttgggtatgagggagggagttatttgggttatagatagattttttttttgtatttaggaggtttaggatggatttgttttatttttttttttggtgggaagagagtatttttggttatggggaatgtggtttggatagagttatttagtttttttttttttttaggtagggttttgaaagatggagatggttttgtttttgttaggttaatagttagtagtttggtggatttttatgtagtttaggtaggatttttttttgtttttattttttattttatgtgtaggaagttggttttaagtagggatttttggttttgttttttatgtgggtgggtagtttttttgtgaggggtaggttaggtttttgttttatgttttttagagattgatgttatttatagtaagagtatataagtttttttggttttaaattaggtttggaggggtggtttttttttttgttttttgttttttgttttttattaaaggttagggaatggagtgttttgtatgtttgttggggttgggtttttttttttggtttaaaatgaagggttggaatttttggtgtagattgtatggtgagaggtgttttttgggatttatttgaggagtattattgttgaatgttttgttaggttaggagtattgttgggggtgggagaggtagttggtttatttgtttatttaatagttatttatgggtattttaagggttagttttgttttaggtattgggggtttaggtatgggtttaggagaaggggtagaatgggagggttttttggaggaaggttttttaattagagattggggtaggagtttgttaggtaggtgatgttggttagttttttttgttattttttttttttttttttttttttttttttttttttttttttgagatagagttttgtttttgttgtttaggttgtagtgtagtggtgtgattttggtttattgtattttttgttttttgggtttaagtgatttttttgttttagttttttgagtagttgagattttaggtatgtattattatgtttagttaattttttgtatttttagtagagataaggttttattttgttggttaggttggttttaaattttttattttaggtgatttgtttattttggttttttaaagtgttgggattataggtgtgagttattgtgtttggtttttttttgttatttttgtagatttatagtgtgtgtggaagattgtatgtttgtgtttggtatagttgtttttggtatttaggtgggaggtgggggagagggttgttggtgttagtataggttatggtatgagataggtttttgtagttaagtggggtgtattgtagtattggaggggttttgttgtgtatgagatttaggttttgtatttgtttttttttttaggaggtttggagggttgggagggattagggtggtgaaataatttaggtgggagagaggtattgttggagaggtagagggagttgtaggtttgtagtagtgagttttaaattttgggtttttattagaaaattttagaaagggttgttttgtttttttttttaaattataaaagaaatttttggttgtttgggttttttggggttgggtgggggaggagattttttatttgtatttttgtaggtttagtattgtgtagagggaggagggtggaggtaaaggtgagggaggagggtggaagtaaaggtggggtttttttttagttttgttgttttgtttggttgttgtttttagatttttatttttggtttggaaatatggaattttgggatagttggggtagggggtatagaatggagattttggtgagggaggaattttttttttagttttggttgtggttatagtaaggttaggttgggaggattttatttaaatatttatattttttttaatatttaaatgatgaagtaggtttttgtatatagttgttttggagttagttgttgtttgttttatttttttttttttttttttttttttttttttttttttttttttttttttttttttttttttttttttttttttttgtattttttgtttttgatttaagtttaggtttttttagttgttttttttttatttataggtattttttgtgattgagtttttttttgttattttttataattattttttttaattgagtattttttaggtgttaggttttgggttggtattttgtatataaggtgttttttaatttttatgagagtttaataaggtagattgggttgttgaggttttagtgttggaaggttggtttgggtttttttagtttgtatttgtatttatttattatttttttattgtggagatttgttttttggtttttggttgagtatgatggaaatttttgtttattagtttttggagagtggggatggttgagggttttgattttggggtttgatgggggttgtttttgttttattttagtttggttgtttttttatttaatgattgagtttgtaaaattagaataatagtgttatttggttggtattttgggtggttgggaggtgtgggagagggtgtatggaggggttgagtgaggtgttagtattgtggggatttttgagggtagtttttttaggtttagggtggagtgtaggtagagggtgtgatggtttagtgtgttggtttatatttggttttgtttttgtttatatggtaatgtgggggagttattagttttttagtgttttagttttttatttgtgtaatggggataagagtaaattattgtttttaggtatggtaagtatttatatatattgattattgtagaatgaatatagtgagttttttttaggtttttattatatgttaggtagggtgttaggttttagtggagaggggataatgatgggtaagttggtttttgtttttaagggttgttgagtagggaggaaggtggtggttgttttgattgtgatttggagtggggtgatttgtaaagaggttggtgggaggttggttgggggttggttgggggttgtttttttttttgtttgtgttttgtggtagggtattaaattggttttttttatggatttttgaggttttgattgtgggattttgggtaggttttgggattttgtgattttgtttttgtttgttatttaggtttttgtttttagtagtgtttagtatatggtgatttttgtatgttttttagtgtgtgattgattttggagttgagatttggtagttgaggttggatattgtttttggataatttttggggaggtgggggtagggtggggttgtgagttggtaattttgagtttttagtagtttttgaatggaggttttttttttgtaggatttttggggaggaaggaggggatgggggagatgaggtttgtgagtttttaggagggtagaggtttatatttgtagtgttttagaaatattttggggtgtttaggtttatttagtttttttgagttagaattattaagagttggggattagtagtttattttttagtaagatttagaaatgatttttttgaatagtttgagttaagaatgatatatttggaattagaatattagaattatagaggaattgagagaatgggtttaaaatgtgtagggattttagttatatggtgttatatggaggaaagtatttaatattattattgtatgaatttgtttaaatatatatatatatatatatatatatatatatatatatatatatattttttagtaaagagtggaaagatatttgttagaatattgatggaagttatttgggttgtgggtttatagattttttttttttgtttttgtgtattttgtaaatttttggttttgtgtttaaattttttttatagttaggaataaagtaatagatgttattttttaaagtttatgggtttgtgtttgtaattttaatattttgggaggttgaggtaggaggattttttaagtttaggagtttgagattagtttgggtaatatagggagatttttatttttttttttttttttttttgatagagttttattgtgttttaggttgaagtggtggtggtatgtttttggtttattgtaatttttgttttttaggtttaggtgatttttatgttttagttttttgagtagttggattatagatatttatatttgtaggatttgagaattttataagaggaaagtttttatttggaggttgttggggatttggagttgttagtttatatattttttagtagagatagggttttattatgttgattaggttggttttaaatttttgtttttaagtgatttatttattttggttttttaaggttttaggattataggtgtgagttattgtgtttggttatgggagatttttttttaaaataagaataaaaataaaaataaataaaagtttattgttaaaaagaaaaatatattatttaatttaatttttttttaggattgagagatgaggaagtagaggttggaaagtgttatattttttggttgttggtagttaggggatttgaggtttgggttggtttttttgtgttttaggtttggggtgttaggtggagtttttgttttgtttaaaggtttaggtgtttttgttagtattgtttgtttttgtatttttggttataaggaatgtgggttaaaggtagggtttttgatttttgtttaggagggtgaagtgggttggttttttttgtttttgttttaaggtttttgtggttgtgtttttggaaattgttggtttgagttagtgtgtggagttgggatagattttattgtggtttttgtggggttattttatgtttgggttggaagggattttttggtttagttttttttgttttttattaggaaattgagattagagaggttatttgtttggtttggggtggggtgtagatggtgtttgtgatttttgtatgttatgtgtagatagttttttagttgtgggttttttatgtaagtagttatgttggggataatttggttgaaatttgtgatttaatgaagagaagaatgattttttttgtagttttgtgttttataggtttttttttgtttttattttttttgtagaggggttttatgttggtgggtgggtttttgttgttgtaatgggtttaggtagtttttgggtagtggaggtttggttgtttttttgtttaatgttttttgtagtttatgttgtttgggaagggtggggaagtatttagttattggggattttataagatgggtatttgggagatgttgattggtaggttaggtttttgtggtttataggtaggttagaggttatagtgttgagttgggttgagttggtagtttagggtagtgggggtgggggtattttgtttagttatgggtttttttggtataagggtttggagtttattgtaaataatttttttagttttttttttttttataggttattagtagaattgaggggttttttgttgatgaggtgtggtttgggaggggttagttgtttgtttatttgatttttgtggataggtgattataggttttttgttttagggggttgggggaaagattggggaggtttttttggtttttttatttggaaggaaaatatgggtataggggagatattttatagggatatattttagttagtattttttggttgtgttgggggtatagtgtttgttttgtttataagaggggttagttttttttaggatttaattttagtttttagtgtagggtagatgagtatttagaggtttagaggatttatattatgagagagaagttgtgattatataggtattgaaggttaagtagaagagtgggatatatgggtgatttgaaagttttagggttagtgtggttagttttagatagttggggagttttgggtattaggtttagtaggggaggagggtttttgtgatagtttgttggggttgttgtaataaagttttatgaattttgggggttgaagatggttttagaggttagaagtttaaaattaaggtgttgattaggttgattttttggggtttttgtgggaggttttggtttaggttttttttttagtttttggtggtttttgggtgtttttgggtatgtagatgtgttatgttattttttgttttgtttttatatggttttttttttgtgtttttgtgttttgtaaggatgtttgttattgtatttagagtttattttaaatttaggatattttttttttgagattttttattgtatttgtaaagattttattttaatttttgttatatttataggtttgagggttagggttttggtatgttttttgggggttattatttagtttattgtggtagttgattttaggggaagtagaatgttttaagtttggggtgagtggagggaatgttgttgggtggggagtgggagattaggtttggagatattgtggattttttttgtttgatgagggtgtgatgaggtttttattttaggttttttgaatggtggttgtttttgaggagatttttttttttggatttgtttttttagaaatttttatttaggtttaggttttaaggtggatggtaagaggtggttgtttttgttatatttgatgggtgagtgtgtgaatggggttgggagtaggatatttgttatttttgtggatagattttagaggtttatgaatttgttgttggggaaggtgtttgatttagtttgattttttatttttatttttttttttttgtttttttttattagttttgtttttagagttttatttttttaaaggtaggtgttgttttttggattttttagtagttattttttattttagattttttttttgtaggtttttttggttttagtgtttatttttttttgggtttttgtttttttattgtgaggtttttgggtagaagtgtggggtttttttgttgtgtttggtttttgtggtatattaggggtttttttaggggtttgttttgtttgttaggtttttagggagttttttaagtttttagatgggtttgatggagttttttaatgtgttgttttagagtaggaggggttttggttgagtttgagagtttttttagttatattttgggttgtttggggtagttaggtagtttgttttttggaggtgttgtttttttttggttattttttttggaattttttgtgtttagttgtggttttttttatatagtatatttattatttttttttatttgtgatttttttttgttaatttttttatgtttttgagaatggagattaggttttttttattttggagtttagtagaatttaaattaggtagatttgtgtaggtttatgtgggggttttgtggttattgtggttttgttgttatttttagtttagtttggtgtgttttggattatgttatttagtgttggttttttaaattttttttttggttttgtaggtttgggaagtagttggtttttgggtgtagttgtgattggagtttgaattttgttttttggggttattgttttttgtaattaggttgtagtttatattggtttgggtagaggttattggttgtttgttttggggttataatatagagagttttgtgattaatggaggttttatttgggttaagtggtttttggtgttaggtgtttttttttttttttttttttttttgtattttttaagtgtttgtaatattttttttaatggataatgagatgaggagggagggaggggtggtttttttgtttaggtagattaggaatggttattgtttgtgtgtgtagtgataggtttgggaatagataagggagagtttgtttgggaggttggatttttatattgatgttgtttgtgtttggtagttttgttttgggttttagaatagatattgattaatatgttttttagggtttttaggtttgggttttggtttttggtagagttttttatttatgggaagaagtattgagtagttttgttggttttttgtagggagttgggatgtatttttaagagtagtatgtgtgaagtttggggtttgggtaaaggagtgtttggggaagagtttgttgttgttggagggttggaagtagaggggaaggaggggtatgtggtaggttgaggaggtggttggtgattttgtggtggggatgagggggttatgagtagattaggagttagtattatgtttttttgtttttagaattgaggatggagagttgttagagaggttttggtggggtgtttggggttatttaaagggtgtgggtggattaaagttgaggaaagttttattttgggggattttgtatttaatttttgaggtttttagagttgtagtttgtggttttttgaagttaattattttttagggttttgtttttgtttttagtgatagttatttattagggagtttttgatttaaggagatttgaaaggttatttggttttttttttatttttaggtaggttatatttagatttttttatatagatttgttttatttttttgttgttttttattagggatggagggtgggtggtttttttatttaggttttggtggttttattttagttaggaaattttttttttttatttgttttatatttttttttttgtggtttttgtttatttttttttaatttgtttttagtggagtagttagtagttggtttagaatttgggggtggggggagtgttagattagtgtagtatatttgagagtgtgttagaggtgtttttatttttatagttgatttagtaaagaaaagaggaagtttagtaatttagtgttattttaaagtttgtttggaatgattttgtggttgttggaattaggggtatgtggtagatgatgggagtaggtatagagaggtttttgttttggattagttgttgttgtttttttggaggttgggttgttttttaagaagaggatttaaggttttgtgagtggtggttttttttggagtttttattgtggttttggttttgttttgtgtaaagagagatggtttgaagtagaagttgttatgtggttgttttaggtaggtgtttgtagttttagttatttgggaggtggaggtaggagaatggtatgaatttgggaggtggagtttgtagtgagtagagatggtattattgtattgtagtttgggtgatagagtaagattttgttttaaaaaaaaaaaaaaaaaaaaggagtagagaaattttttttagaaggtttgtagttattttttttttatgttttagaggtaaaaaaaaaaaaaattgtatattttgttttttttttttttttttgagatggagttttgttttgttgtttaggttggagtgtagtggtgtgattttggtttgttgtaagttttgttttttgggtttatgttatttttttgttttagttttttgagtagttgggattataggtgtttgttattatgtttggttaattttttgtgtttttagtagagatggggttttattgtgttagttaggatggttttgattttttgattttgtgatttgtttgtttttgttttttaaagtgttgggattataggtgtgagttgttgtgtttggttatatgtttttgtttttgaataggtggttttttgattttgggtgtggttattttaagattttgttttggtggggtataattttggttttaggtagggtgattgtataatttattgttttttgggggatatgttagtgaaagggatttttgaatgattatggtgggataatagatgtgagttgggtttgttttaggaaggttggatgtatgggttttttgagttagaggagataatagtagaaagttttgtggttgatgggattgagtaggagaagggttggtggaggttggggtaataatgtatttgtttattgtgaagggtttgtgtgagttgatggttgatgagagggtagtggggtgaggttgttttttgttaggttagattagttttaggatatttatattttttttttagaattggtgatttagtggttagaaggggttttagaattgatgggatattgagggagttgaatggaatggttggagtggttatagtaggttttaggtttttttttgttttttttttgtgttttgtttttggggtttatattttggggttgttgtaatagagtgttataatttgggggtttataaatatagtttttggtggtttttggagatttttggtgttttttggtttgtagatgtattattattatttttgatttttggtttttgtttttatgtggttttttttttttgtttgtgtgtttttttttttttttgttttttataaagatgtttattattggatttagggtttattaaatttagaatgattttattttgagatttttattttaattatatttgtaaagatttgttttttaaatgtgattatgtttgtaggttttaggagttaggatttaagatatattgttttgggggatattgttgaatttattatatttaataaatttagagttggtgttaatgttttttgtggatattatagtagattttggaggttttttgtaaaggaatttgtaggatttttttttttttttggagggatgagattgtagttgggttggggaaagttgttggtttaagttggggttggtttagttggtgttggtttgttaggttgttagagagttttatttagggagaaattaatattataaagttgggggataagagaaggtttggaattttaagggttggttgttgaggttagttgtttatttttttgtgttttattttatagggatttaggtttgttagtgttttgtttttggaaggaatgttgtgggttgttgtgttttataggtagggtggagggtttttttgtagttagtgagttgttttttttgtagtgtgtagagggaaggaggaggtttgtttattttttttggttttagttgaaaatttaattataggttttggtattaggtagatttgtttatttttatattattattgtagagtgagttaggttttttgggtggggttgtgatgagtaggaaggatttttggagtgtttgggattttttgggtttagggttgttagaggtagagagaaagaagtttttttttaatatttgagtaaagatagttattagaatttattagagtggttttttgtggtttttttttgggtgttgatttttttggtgtatttgaagtttttagggatattattgatgttttttgtatttttatttaggggttagtggaaatggttttttttttttttgtttagaggtattgtggatgatgattttaggttttagattttagttattgggttatgtgtgtagataagtttgggtagttagtaatttttggttattaagttggttttttgtggattgggttggtattggaggtgggttttagttgttagtattgtggtttagttaggtttggttttgggaaggtagagggggaggggattgggaaagggattgagttgggggtggggtggtattttggttttttttttttagatttttggtaggtttgaattatttggttgtggttttttaaggagggagtgttttttttgttttgatgtggattttgttttttgtttatgttgtttttgtttttaaataaatgtggttttttgtggggagtttgggggttgttttttattgatattgttgttttttggtttttttttgtaggttttgtttagttttattgtgtttatttttaagtttttttttttggatggttttgttttttgagaatatatttttttttattattttaattgtgtttttttttttatttggagtttgttttatttgttttaggagttattttttttttttattaagtagtttaggttaattttggagggttaatttgtgtttttttagaagtaggttttgagatagggattttagtgggaggggatattaggggatgtttgagtgtgggaatgggttaggtagggaatttagttaataaagggtgttttattagtttattgtgattataggtggttgtttagtttttatattgggtagtatggggagattgtagattgtgtttttagttttgttttatttggggttgggtaagggagttggggtttttatattttagtttttggttaaggattgtattgtttattttttttagttttttgagggtttgggtattaggaaaggttttgggtggagatatggaaataggttatgtgaagttagtgggtgtgattggtagtagtaaggttaggatagttttggttattagtaaggtgattatatattttagtatgtatagtttttatagatatatatttaggagatggtaattatattagtaatagttatttttgttgtgtgttatgtttgtatttagggaattttattttttatttatttatttatttttatttgagatggagttgtgtttttgttgtttaggatagagtgtaatggtataattttggtttattataatttttgttttttgggtttaagttattttgttttagttttttgagtagttgggattataggtatgtattattatgtttgattatttttgtatttttagtagagatggggtttttttattttggttaggttggttttgaatttttgattttaggtgatttatttattttagttttttaaagtgttaggattataggtatgagttattgtgtttggttttaggggtattttattattttattattttttatagtaggtgatattgaggatattgaggtttagagtagattgtggttatgttatttttttgtttggtttttttgtttttagttttgaaataaagagtatggtttttgtgtaggtttatatgttttgtttttagttttggagtagtttttaagttttttgaaggtatattaggtttttgggttttgttttttaagttttggataaataggaggtgaaggagtttttgtaattggattttattttgttagtgttaaggttttgtttgattatttattttattttatatagattagggatttgtgttaaggtttagtgttataggagagtgaagataaggaggtgtttatggtgtatatgttgttggatttattttgtagattttaagggttatggggagttatttgttaggtgaggtttttttgtggtttttttttgtaggtttagggtagtatatagggaggtgtttttttattttttggtattatttgtttggtttttttgagttttgattttggtttttagatagttagtgtttttttagggatagaatttgttttgttgttgtttagaggagatttagtttgattagggttagtgtttttggaatttgagtttggaattttattttgttttgggtagaggttatgttgtttttttttatgagagttgagttgtgtatgagattattttgattttgggttttattatttttttgtatgatatttgttttaggttggagtagggttttgtggtttgtttggtgttttttttttagattgaggtttgatatgtatattaggaagtgtttgatttggttttaggagttgggagtggtttgttaggtagtttgtggttagagtaggggttttaataatggttttttgtgtggtatatttttttttaaataggtttaggtttaggttgtttttgttttgattttgttatgggtttggaggggaaagtttgtatttggagggtggtttattgtggtttttttttgtgtagtagttgagattgtaggtgtttgagaataggagaagttttgtgtttattttgggttgtgagatgtttttttagaggtggggatggggatgggttagtatgtagttatttatattttttagtttgttggtattaaggtttgtgtatgtgtgtgtttttttttttttaattttgtttttttaatatggagttttgttatttgtttaggttggttttggatttttggtttaagtgattttttagttttaggtttttaaagtgttgggattataggtgtgagttattatgtttagttagtattaaggtgtgttttttaagagtaatattggttgggtgtagtggtttatgtttgtaattgtagtattttgggaggttgaggtaggtggattatgaggttagtagattgagattattttggttaatatggtgaaattgtgtttttattaaaaatataaaaaaattagttagatgtggtggttgggtatttgtagttttagttatttgggaggttgaggtaggagaatggtgtgaatttgggaggtggagtttgtggtgagttgagattgtgttattgtattttagtttgggtgatagagtgagattgttttaaaaaaaaaaaaaaaaaagaataatattgatggttttattttttgaatatgttaagtgatttttatgtagtataagtattttagaaggtaggaaaatgtaatgaataatatttattgttatttattttatttagagattgttattttttgtttgggtgtgagtgtgtgtgtgtgtgtaaattgtatatgtgtgtatgaaatggaattaggatttttgtatatattttgtgttttgttatttttatttaatatttttggtattttttatttttaaaaatgtgattttaatgatggtgtaggtttttgatatatgggtttagaaaatttgtggaaatttggattgtttttaggttttgttagtttaatgttgatgtaaatgtttttgtatgtaaatttttttgtatttttgattatttttttgggataaatttttagaagtgggttaaagtatatgaatggtttttaggtttttggagtaagttgagattggtggggattggagaagggatttagggaggtttttgggagtttgtgagattggagtttggttttaggggatttgaatttatagatgaaggagatggttggtaaaggtgggaattttttgttttatgggtgggggggtgatattgttttattttttagtgatagtatggggatttttttaatatgatttggttttgtatttttttgatattgtgtatggtttatagttgtgatgtttagttgggagttttttttgtgttttttagttgtattaattttttgtagatagaggaggaagttgtttggtgtttttttttgttgtgtgggttttttgaatttgtttagttgggtttgtggatttgtgtagttatgtatggggttttaaaatttgtaaaatgataagtttatgaatatttttgtttttgtgggtgaatgtggatattttttggttgtgtttttttttatagggaagatggagatgtgtaaagtgataaggatttgttatttttgggtaggttatgttggttttattgtgaggatggtggtagggggttttttaggaggtttgtatattgggaagagaggggtgattgtgtgtgattgtaggatttagggtgtagttttaggattttgatgggggaggagatgttggggagttttgttttgttagtttggtgatagatattttttaatgttttttggttgggtataatttataatgttttttgtggggaggtaattgtttatgaggtatttttggtagggatgattttgttttattgttatatattttagtaatgaaataagaatttagagtgatgtgatttttttgatgatttttttaattatttggggtttttgtgtgattttaagaagggggaaggaggtagtttttgtttttttgggtttttgatgtggtagttttggaatggttatgtgtttgttggtttatagtgggttatttgttgaatgtggttgtggtgggattggggttgggttggagagtgggtgattatattagttagttttattttgggttattgtgtagttaggggttttatttttttaggggttttgttgtgagtgttttggggttgttggaataaattattggaaattaagtggtttaataaagattgatttgtttatggttttggaggttataagtttgatattaaggtattggtaggattatattttttttgatagtttgaggggaggatttttttttgttttttttagtttgtgttggtttaggtgttttttggttttggtagtatttgtagtttttgtttttattatgtagttttttttattgtgtttttttgtgttttaagtttttttttgttttttttttataaggatattgagtattggatttagagtttattttaaatttaggatagttttattttgggatttttaattatatttgtaaagattttttttttaaataaggttatatttgtgggtttttggggttaggtattagatatgtttttttgggggttattagttaattttttatagaattttagatgaaagtgaatttttataggttgaaatgggggtgaaggtttagtgtgttttttttttttgggagtttttttagggtttgtgtttattttgtgattttgtgatttagttttttttttgagatgaagttttgttttgttgtttaggttggagtattgtggtatgatttgggtttattgtaatttttgttttttgaatttaagtgatttttttgttttagttttttaagtagttgggattataggtgtttatttttatgtttagttaattttttgtgtttttagtagagatagggttttattatgttggttaggttggttttgaatttttgattttaggtgatttgtttgttttgggtttgttttggttttttaaagtgttgggattataggtatgagttattatgtttggtatttagtaggttttggttgttttttttttttgagatagagttttattttgttatttaggttggagtgtagtggtgtgattatggtttattgtagttttgattttttggttttaagtgatttttttattttagttttttgagtagttgggattataggtatatgttattatttttggttaatttttgtattgtttagtggagttggggttttgttatgttgtttaggtttgttttgaatttttgggtttaagtgatttgtttattttggttttttaaagtgttggggttataggtgtgagttattatgtttggtttagtaggttttttagaagtgtttgaggtttggtgaaggtatggtgttatggagtagagaatatttaattttgtttttggggagttggaatatattttttgtagttaattttaatagttatgatgtggttaggatgatatggggagggggtggtgtggattgtgtgggaggttagttttttgggaagggggttggagtgggtttggttttgaggaggatttttaagaggaggaggaggtggtggtatgtttgtttggggggatggtgtgagttagggtgggtatttttttatttaggtgttatttttttgatattttagttgggatatggtttttttggggaagatggatatttttagagtggggtattttttggggaagatggatatttttggaatggggtgttttttgtttttattgtttttttagtatatagttgtatttttttgtagttttggaggttgtgagattttttggttgttatttagaataaatttgtttttgagtagtgttgttttgatggtggggtggtttttgtgggtggaatagtttttgttgttttagagtttattgagagttagtgggtatgggagtggtgttggattgaaatatttagagggattatagagttaggtagtaagtatagaggttagttagtggggagggagggatttatttatgaaaagatattaagtattgaaagagaggagaggatggttggggattggtatatatgtgtattttgtgtagatggttaaggtggtgaggtgttagttatgtagataattggaggaaggaggagtgttttaggggaggggttagttttggttttagaatgatttgtttgtgtatgtgggtttggttggaataaattattgtatttgtattgtagatttaattgtaagtttatattagggtagtttttgttttggtgtagtgtttttgattatgagttggttatggtgggggtgattttaaggggatttttaaggagggggtttattggattttttagggaaggttatttgtttttttgggttggatttgggataaggtttttttttgtttagtttttgttttttaatttgattgtatggaaggatgttgaggatatttggaagttggtttttgttttatagtatttataggatagaggtatattatgtggggatagtttggatagtgtttaggaggtagggagtagattagaggattgtgggaggttttgggaattgtatgaggatttaggtattgagttttgtattttttggtattagtttgatgtatagtttggttttgtgtttattttgtattttattttttttatttgtatgggggtggtaataatattttttatagtttaggtttaagtgggtgtagatgtgatgagtttggtaagtttattttattatatttagttttgggtattgaattttggattttttggttggtagaagtggatatttaatttttttttggggttttggggtttttgtagaattagaatatagttagtagtttgtatgtagggtgtagagggatagagggatattatgttgggagtttatatttggtatatttttgattttggggtttagtgttttgttgttttgtggttatgtgattagttagaggttatggttggatttataggtgaatatagtttgtggatttgattttgtttggttttgtggtgttttattttatttttagttttagtttgtggagatagagttttgttttgttagttaggttgagtgtagtgatatgattttagttttgtaatttttgttttttgggtttaagtgatttttttgttttagttttttgagtagttgggattataggtgagtgttattatgtttagttaattttttatttttagtaaagatggggttttattatattagttaggttgtttagtgttttaaaaagggtttgttttgttttgtgttagtatttaaagattaggagatattatataaagatttagatttttatttttttgagaagtgaatagttttggttatgttgggtttatattttttagggtagtgatggagttgagatagggtttgtgataattgagagttttttggagtttatatggttttttgtttagtttttggtggaggttgagtttagtgatttaggattttgtttgtgtttattaagaaggagaggtgtttgtggtttagagagggtgtttataggagtgttttgtttaggaagttggtagttgaggtggttagggttagggggttgggttttttttttttttttttagtgtttgagtgtatttggaggaagagagatgggtgaggggaaggtattgaaattggttttggagtgttattattgggggttggggattagttgttatttttttttttgtgggtaggggaggtagtggtgggattttatgagatttggattttgtggtttggtgaggtagggagtggttggggagatattgtgggtttttataggggtgtgttgtgggtttggtttggggaaggagttggtgaatgtgtttgttatgtgggtttttttttgttttggttttgataattaggagtggttggtttttatttggagtgtggttgtggggattgtggaggtggtagttttttaggtattatttttattgtttttgagggagtagattttggtggagaggtaggatggttgtagggtgggagttggtggttggtattattgtatgggtttgtagtagtggatgggaagatgtaggagaggttgatgattgagaaagttggtttttgtggattaagttgggggagttggataattaagtggttagaattttgggttttggtattagtttgatgtatagtttggttttgtgtttattttgtgttttattttttttatttgtattgggggtattggtattttttatattttagggttaagtggttgtagatgtgatgagtttggtaggtttggtgttttgttggtattgaaagttttagtgtttgtttttagtgttattgatggggttttgtttttgttgtggttttgattggttatagttgtggttatttattattggaggtatgttttttgttgtggttgatggtagaggtgtgtttgttggtggtgttttagtgtgtgttttggttggaggtgaggagggataaaaatagttgtgataagaaggaaattaaggttgggtatggtggtgtatgtttgtaattttagtattttgggaggttgaggtgggtggattgtttgaggttaggagtttgagattagattgattaatatggtgaaattttatttttattaaaaatataaaaattagttaggtatggtggtttgtgtttataattttagttattggggaggttgaggtaggagaattgtttgaatttgggaggtgttgttgtattttagttagggtaatagagtaagattttattttaaaaaaaaaaagaaggaaataaaagttttttttggaattagaatgtttttatgtagatgtagttggagggggaggttgtgtggtttgtgttgtggttatggtaagatatgatgggtagtatttttttattttagtttgtatttttgttttagaatttatgatggtttttttaggatggggttgttttttttgtttgttgagatatgaaggatgggaagagatttttggtttttattgttgtattgtttgtttttttttgttgttttttagtaggaaatatgttggagtgttttttagttatttatttattaattgtattttttttttttattttttagttttgaaaagattttttgaggttgaggaggttgagatatttaattttattttattttggagggtttagatttttttattttgagttattgtggttagttttatttagaaattttaggatttgggtgtgaagaatttagaatttttggtttgttatgtggattttttaagttaatgtttttttaaggtgtttttgtggagggtggagtttttgggttttaaggtggttgagttggtgttttggtgtattgagttgtttattgatattttgtttaagtaggtggagaatgttggggttattggtttgttttggtttgggtttaagagggttgaggtgttgggttataagatgttagaattggttttttggaggatggagattattattgttaaattttaggagttagtttattggaggatggagttttttgtttttaaggtttttgaggtgtttattgtttttgttattgatgtagtttttaagagggtggagatttagatgtttaagtttgttgaggtgtttattgtttttagtttagtttagattttggagaatttagagtttgtttttgtgttttagttgtagagtaggttggagtttaagttttagttttttgtggttgaggttatattttggagttaggagggtgagttgtagagtgttaggttttggatgttgtggtaatggggggtttggttgttggttttgttatagaattttggaggaagaagttggatatggggtggagggtgttattttggagatttagaaagattggaatgtatgggggtgggggtttgtaagtttaggagaggtggttttttttgtttgatgggaatatgttaagatgttttaagtgggatttgaatgagagtttggaaagattttttgggttttaaggagttttttttatgggttattgtgggttttgttgggatttttgtttgttgtgtgtttttggagggtttgggaggtttagagaatgaggagttatgtaggaattagggtaggtttatgtaggggtgtaggatagggtggagttgagatttttagaagggttgttatattttggtggtttttgtttgaggaattgtaggttgtttggatatgtttagtagaggttgagggtttggggaagggaggagggatgtatgttttttgaggtttgtattggagtttatggtttggttttttttttttaggagggatggttgtggtagagggaggggaatatgaggagtattttagtttgtaggataaaatttttagggtattgggaaggggtgtttggattagggggttgtgtgatagttgtatatggttttatttgggggtgtttttttggtgagaggagagaggttatggggttttagtagtgttttgggagggtttaagtttatagttgtgttgatatggagtttataggtaggggattggtgttagttttgtgggatatagggtttgtttggaaatgttaggttgtgggatatggttgggtttttttttagaagtgtgttttttggttttagtagggattgtggttttatggggttatagtaaggtgttagttgggttagaagttttttaagagttaggtttgattttgggtataggattagaatttagtaatgtttagtaagttttttttaggttggataaatagtatagtttgggtttttgatttagttgttgttttttatttttaattgtggtgaaatatataatatataatgtgtaattttagttattttgtagtgtatgttttagtggtatttagtatatttatggtgttgtgtagttgttattgttgtttatttttggtattttttttatttttttaaattgagttttgtttttgttagattaagttttttatgttttttttttagttgttggtagttattattttattttttgtttttattatgaatttatttgattattttaggaattttgtgtgtgtggaaaaatataataattgtttattttgtgtttggtttattttatttagtatgatgttttaaaggtttatttgttgtgttgtagtatggggtagaatttttttttttttagaggttgaataatattttgttgtgtgatgtatttgtgttgtgtagttgtttttttattggtggatttttgggttgtttttatatttttttaagtttttttttttattttttttgatttttttttgatttttttgagatagggttttgttttgttttttaggttggtgtgtagtggtgtgattattgtttattgtaatttttgttttttgggtttaagtgattttttagttttagttttttaagtatttaggattataggttgtgtgttattatgtttggttaatttttaaattttttttgtagagataggtttttattaggttgtttaggttggttttaaatttttgggtttaaatgagttttttgttttggttttttaaagtgttgggattataggtatgagttatttaatttttttttggtttttttttttgaatgagagttttttagtggttagtgggtttgggggttgggaggatgtggggtttggagagggtgtgggtttggggggagattagtgttttttatgtttttatgggtatgtggagtgtatatttgttttggtgggtttggggtttgggattttgtattttttatagagggggtattggaatatattgagtagttagaggttagtgggttttggaaggttttttttggtttttagtgtgtgagttttgtgtttttttttttatttttttaagtttgattttgaagagttattttgttttagttatttagatttagtgatagtggttgttggtggtatggtgttaggttaaaggtatgggtagtttgtagagtggtaggaggttgtttttttttttgttttttgttggtgtaggatttttgtttgatgtgttggatatatttttattttgggttgatgtgtttatatttagttgagttaaataggatgtggttggggaggtggttgttattgagttatttaaattttggtgatggttggtgttggatgtatagggatgtggttttggttttgggggataggtagggggatgtttatggggatgtataagaatatttttttttaggggtagatatagtttagtttttaaattgtgttagagattgtgttgggagttaggtttagggatataatttgtgggttttgttttttggagtttattgagttgtgagtaggatggttgggatataaggagtgtttagggagtttttttagtagtggaagtataattttattaggttaggaaggggagagaaaggtaggttatgtggaggtagtagtgtttagagttgttaggaatttggtgttttggggggatggtggttttttttatggaataggatgtatatgttggagttggggtatgggagaaaattattagtattttagatttggttatttatggatagggatttgtgtaggtgggagtttagtttatgtggagaggtttgtgggttgggttgatagttttgagggtttaagtaagtttaggtggaggaaatgtagggatagatgagggtagggtttttttaatggaggagtgtttttgaaatttgatgggagtggttttttggggggtttaggtttgagttttattagttttttttttgaggtattatttgtttgtttttttgttttttttttttgtgttatgattgttttggatatggatttagttttttttaatttagttttttgtttattttttttttaggtttatttttttttgtttttttatgtggggttgggttgggagttttttgagttttgatatgtatagttttgattaatttttgtggtttttttgttttttgagtattagggatttagttggtattatggggaaaggaattatggagggagttttgtgttttttgagtagatgtttagttttttggtttttgtttgtgggagggtatttgtgttgtggtttgtttttattttagagttgtgggtgtagggtagggttttttggggttttagttgaattgtttttagattgatttttttaaagtatagtattgttgagatttttttttgtgttgagttttttttgtttatttattataggtttttttatggttgatttatttttttgtttagtttatattttttttttttttagttttttttgttttggtttttttttggttttttatatttttttttataatttttttgttttgattttttgaattttgatttttgtttttttttatattattgttttggtgaatttttatgtattttttaaaatttggtttaaatattttgtgtttggtttgggatataaatgatttgtgtataaatttttttttttttgttagatttttttttttaaatgtgaaagtagttttttagattataaaaagtaattgagtattttttttttaaaatgtaggaagtatagaaatgagaaagaatttaaaatttatttgtaagttagtgatatttatgtttgaggttttgttgtatagtttttaaaattttttttatgtttttattagattttgagggtagggttgttgtttttgtttttttttgtgttttttttttgttttttgttttttgagatggagtttttttttattatttaggttggagtgtagtggtatgattttagtttattgtaatttttgttttttaggtttaagtgatttttttgttttagttttttgagtagttgggattataggtgtgggttattatgtttggttaatttttgtatttttagtagagatggggttttattatataggttaggttggttttgaatttttgattttgtgatttatttattttagtttttttgattttttaaagtgttgggattatgttattgtgtttagtttgttttggtttttataaagaattttataaggggttaggtgtagtggtttatgtttgtaaatttagtattttggaggttgaagtaggtagattgtttgagtttaggagtttgggattagtttgggtaatatagagaaattttatttttataaaaaatataaaaaattagttaggtatgatagtatgtgtttgtagttttagttattggggaggttgaggtgggaggattatttaagtatgggaggttgaggttgtggtgagttgagattgtgttattgtattttagtttaggagatagagtgagattttgttttaaaaaaaaaaaaaaaaaaaaaaaaaattttataagatattaagtaagtgatttggatataataggtgtgttatgaaattatgttgaaggagtgagttattggtggtgagttgggatggtttttttgtggtttttgtaggtagatgtagtgatttttatgggttgtttttagagattaagtagaaatttttttggttaattttatttttaggatatttggttttttttttggaggttgtgttggagggtttagtgggtgggtgttggttttagtgtgggggttttggaaggagttagtattttaggagggagtgtgggtatttagatggttgaaggggagggagaggaagagaggtgttgtagagggtagaggtatttttgtttgtttttttgttttagggtttggtgaggtttgagttttatgttggtggggtggatttttggtttttgaggttttggttttgtttttggatttggtattttttttgttgtttttttatagaagggtgtttattttttggggttatttttggtttttttaggttttgggtggggatggttttgtttttttttttggatttttgttttttttttgttttttaatatgggtgtttttgggtggagtggggtggggttgggttgtagtatttagtattgagtttgtaagggttggttgttggtttagagttttttttattagagttatttttttttggttttttagttatattagttaagtttttttagagttgttttataaggtgggtgtttagtgtttgtttatgggtttggttttttgtttttttgggatgtttattgggggtaagagggaggttaggtttagtgtttagtttagttttgggtatgttttagttttgttttatgagttaattggttttgaattattattttattttttttagttttaattttttgatttgttaaagaggtatttgtagaggtggttgggggttgagtttttatgtatttatttattttaagaattaagaagggagtttatagtggttttggggttatttgtgaatatggatgtgaaattggggtggggtagatatggtagtatgttttagtagtttttttgtgatttagagggtttggaaatttttgttatgtgggtggagtgttgagggagtagggggttaggtttttttgagttgatgatggtgggtgtggttttttgtatatttggtttgtattgggttgtgtgttttaggggtagaatagggaggaattttagtatagatagtagggttgttagtatagtgttgagtatagggttaattaaagtatagggttttttggaattatttaatatagagtagtgaagaggtggttttggggaaagtggggttagagttgagtttgagtggggggtggggagggtgggtattagtttgtaagggagggatatttattgggttttagaagtttttggtggggattagggattgtgaagttggggagagggtgattattgtgatttagggaggaagggttttatagatagtttagtttttggttttgtgtttataggatattttatataggttttgagtttatttttggattgtggattttttgaggtagggtgtgtaggtttgtttagtattaggtgtaaggtagggggttttggtaagtgttgagggatttattggtgtttgatgaagtagtgagtttggattgtgttatgttttgggttttgagtttgtaggatttttttgtggggttgtgtgtttttgtttttggaggtgtttagaaggtattgatgtttttgttgggatgttttatttggaaggttttgttgtttttatttttttttatttttttgagttgtttgtagagggtatttaggtttttttttattttgggattgggtttttttttttttttttttttaagaataagtattttttttttttgaattgtttttggagttttttagatttaggtttagagtgggaagttttgtatgtgttgggggaataggaattaatgtgggaggattggttaggtttggtgtgttttttttgtggtgggatggggtggggttagagaatagagtttggttttagagtttaggaagagaatttttttttttgttggtttgttaagtattgtgtagtggtgagaggaaaggagggttggtttgggaatgtagtgggtgttgagtagttgtggaatattttaaatagagtgtagttgtggggaagggtggggttaggaggtaggtgttgggggtggtttttttgttttgttttttgtagttttgtggttttgattatttagtttggttttaggatggagttttggtttttagatatatggtattgggtgaggttgttttttagtatttgttttaggaagttagagtagttgttagaagagagaggagttgtgtttgtatttgttgttttttaggtttgggatagttgttgggattgagggtttgtataatggtgagtttgtttggaggggtgtgttgtggttagatagttatgttttgtgtggtgtggatagagggtatatttagttttggaggagtgtatttagattttttgttttggggtttaaagtgtgggtagtttttaattagattttggattttagtagatagtttgggaggatgttatgtggtttattttgatatattgttttatttgtgattttatttttgagagttgtagggaggtgtttttttagttggattttattttttttttggggttttttgtgggtgttataagtgattttgttttttttagtttaaggggggtttttggggtatgggttgtaattgataggttagagtagtttatggttagggttgagttttttttttgttttttttgaatattgggtttaggaaggggttaaagtggagatgttttgattaaagttgagggaggtatggagtttttttgattttgtttttttattttattgttgttattgggtgtattttgtggagttttaggatttttaaagaatttagagtggagatttttggttttatttagtgtaggtgagggggaaagtgatttgtttatagttatatggttattattagtatatttgggttaagtttgattttattttatggtttttgtttgaaatttggaattggaaatggttttggaaattattgattttatttgttgttttttaaaatggtttgtagaggttaagatatagatttttgtaatgttttgtttatttgtgtgtggggaaatggtagaggagtattggttttgtttttatattgtttgggttgttgtttttgttttgtttagtggtttttttttttggtttgtttttttattgtggaagtgggtataattttttttgtgtagtgtggttagagtggatagtgatgatttgtgaagtagggtggagtgtttgggggatttgtgttaaataagtatataaataaaagttaatataatttttatttaattagtaagtaggttttgtttgaagtttttgggtagtattttatgttatttttaggttttaggttggtggtgttgttttgtgttttttttatttgtaagttggtgtttagaagttttgttttgtgttttggtttttattttttttgtgatttttttttttttttattttaaaaagtaatgtatgatggggtgtggtggtgggtatttgtagttttagttgtttgggaggttgaggtaggagaattatttgaatttaggaggtggaggttgtagtgagttgagattgtgttagtgtagtttagtttgggtaatagaataagatttttatttgggaaaaaaaaaaaaaagtgatgtttagttatttttagatagaaaatgaagattatatgaaatttggaaagaagttttttttttttattttttaatttttttttaaggggtggttatgttgatagttgggtgtggtatttttttgaattttatttttgtagagttatttagggtttgtgtaaaaaaagttaatgtgtaaatatagattttttaagaatataaaggaaattagatttttgttattagtttttattttttttatttaataatattgttgttatttgtagatgtagtatgtttttttttttttttttttttttttttttttgatagagtgtggtttaggttggagtgtagtggtgtgattttagtttattgtggtttattgtaatttttattttttgttttttgtttttaagtgatttttttgttttagttttttaagtagttgaaattataggtgtttgttattatatttggttaatttttgtatttttagtagagatggggttttattatgttggttaggttgtttttgaatttttgattttgagatttgtttattttggttttttaaagtagtatgttttttttaatggttgtgttattagttgttttatggttttgttaggtttgtttagttttttattgtgattgagaggttgtaatagatgtttttgtatttgtatatgtgtatatatgattgaaggatgagtttttagtgaatttttgtgttaaggatgtgtgtatttaagttttgatttgttgggtatagtggtttatatttgtaattttagtattttgggaggttaaggtgggttgattatttgaggttaggagtttaagattagtttggttaatatggtgaaattttatttttattaaaaatataaaaattagttgggtatggtggtttgtgtttgtagttttagttatttaggaggttaaggtaggagatttgtttgaatttagtaggtagaggttgtagtgagttaagattgtgttattgtattttagtttgggtgatagagtgagattttttattaaaaaaaaaaaaaaaaaaaaaaaattgatttttgtttttgaattggtttttaaagtggttattagaattttttaggatttttttttttgttgatttgtttagttgtttgttgggttttgtgtagtgatggtttagtagggaggttttatgttttttatttttggttgagggttaaatgttttttaattggtgttttattttgtgtattttggttaagtgagagggattatttttttgtatgttataggttagggttttgtgttttttttttatttggaaggtgtattttttttttgttgaaattttttaaaaagagttttttgtaagttaggtgtgatggttaatatttataattttagtattttgggaggttgaagtgggtggattgtttgagtttaggagtttgagattagtttaggtaatatggtaaaattgtatttttgtaaaaattagttgggtgaggtggtgtgtttgtagttttggttatttgggaggttgatgtgggaggattatttgagtttgggagtttgaggttgttgtgagttgtggttatattattgtattttagtttgggtgatagagtgagattttgtttaaaaaaaaaaaagagttatttgtatatttttattatagtaggtatgagtattttgtttttagttgtttatttttgattttgtttttgggatgtttttttatatagaatattttaattttgatattgttaagtttttgtttttttttttagtttttggaatttatattttgtttagaggttttttgtgttttgaaattataggaaagaattttatttatgtttttttttagtatttttgtggttttatttttatatgttgaaattatgaatttattggaatgtattttggttttagtagtgaggtaggggtagatggtattgtttggatatatagtagtgagtttggtttggagtgggtggggtgtgtgtgtgtgtgtgtgtgtgtgtgtgtgtgtgtgttatttttattagttttggtgtttgtattgtgttggtttagtaaaaataatttggatgtattttttttattttttgttttttggaatattttaagtagtaatataataatttttttgttaaaattttttaagaatttatttgtgaaattatttgagtttgatatttttgggggagtttagtattttaaaaatttaaattttttttatgggtttgtgagtttgggagtttttttttttttttaaaatttattattattttttttttagaaaagtgttttttagtttatttaaaatttgttagtttattttgagggggttgttttagtttgtttagtgaggatagtgtgtagtgtggtgattgatatgattgattagtagagtatgattgattagttggtgtgtaaatatgattgattgtggttagtgttttgggatgttttatgttgaggtatatgtgtgtagtgtagggtgatgtgtattttgagaggggatgaagttataggatttttgtatttttaggagagagtttttttttttaaggttgtagttttgagtaggtagtgatgggattgggtttagggggttgagtggttttagtaggttaagggttttaggaattatgagaagtttggagttgtttagagagtagtttttaaaattagtttggattgtagtttttagaaagatatgtgattgatattatgaattaggatatatttatatatggggtgggggtggggatgggatgtattaatgaaattaaatttttgtgatggaatttttatttttattatgtgtgtgttatatttagtatttttttttttttttttttttttttttttttttttttttttttttgtttgtttgttttggagagagggaaggtttttttttatttttttttaaatagttttattgagatttaagtaagttattatataatttattaatttatttatttatttatttttttgagatggagttttatttttgttgtttaggttggagtgtagtggtgttattttggttgattgtaatttttgttttttgggtttaattaatttttttgttttagttttttgagtagttgagattatagatatgtattattatgtttggttaattttgtatttttagtagagatggggtttttttatgttgaggttggttttgaatttttgattttaggtgatttatttgttttagttttttaaagtgttgggattataggtatgagttattgtgtggtttaatttatttatttaaagtgtataattttatggtttttagtttatttagagagtagtgtaattattgttattataattaattttagaaaattgaaaatttgagaaatttagaaaattttttttttaagaagaaattttgtagtttttagttattaattttgttttttttttttatattttttttttatttgtgtggattttttttttttttttttttttttttgagatagggttttattttgttatttaggttggggtgtaatggtttaatttttgtttattgtaatttttattttttaggtttaagttatttttttattatggttttttgagtagttgagattataggtttgtgttattatgtttggttaatttttgtattttttgtagagatggggttttattatgttgtttaggttggttttgaatttttgggtttaaatgatttttttgttttggttttttaaagttttggaattataggtgtgagttattgtgtttggttgattttagatattttttgtatagagaattgtatgtttggtttttgtgtttggtttttttatttggtgttatgtttttaaggtttatttatattgtggtaggtgttagtgtgtttttgagtaatattttattatggtatggattattttattgtggatagatatgttgtttttattagttgagggatattgggttgttgttattgttggtgagtgtattttttttaaattaaaaaaaaaatgttggttattatttattagattgtttttttggtttatagggtgggataagttggtttgggtgagggttaggaggtggttaggtggaggtggttggagtggttttgggttgtttttgggtgtagtaggtagaggtgtaatggtagagtttgagtaggttttttgggtggatttttatgttggtaatgtttgtttatttaagaagttttggttaggtgtggtgttttatatttgtaattttagtattttgggaagttgaggtaggtagattatttgaggttaggagtttgagattagtttggttaatatggtaaaattttgtttttattaaaaatataaaaattagttgggtgtggtggtgtgtatttgtagttttagttatttggtaggttgaggtaggagaatttgtttgattttaggaggtagagtttgaatttaggaggtggaggttgtagtgagttaaaattgtgttattgtattttagtttgggtgatagagtgagattatgttttaaaaaaaaaaaaaaaaagaaaaaaaaagaaatttttagtgttgttttgtgtttggtattgaagttgagggaaggtagtattagtatgagtttttagtttattgggtttttgtttggagttgatgtgtgattaaggtatatgagggaagtatggtgaggtggatggtgtggaggtataaggagtaaaataaggtagatgtagtggtttagtggtttttggtggttgtgaggagtgtgggtaggatagttttaggagggtatttggagagtagggttggttggggtaaggtgtgttaggtatttgttaggagtaaaatgtaaggggatattaaagagtttaggaattaatatagatagtatttaatgtagtattttttaatattgaaatgatgtatagtaatttttatgatgaataaatgttggaattttaaattaagataggtttagttttgtatgtgtatagttttgttagagtttgtttagtgtggaatttgatttgtttaaaatgttgttttaaaatattgtttgatttttggattttttggtattgttttaatttttgtatttggatgaaggttttattttaattttagttggagagggttaagggttggtgaatttggttttggatttgtagagtttgtggtatttgagaggtggggttaggaataggaaggagttggtgagaatggtatttggtatgggatggggttagattagagtagtattgtggttttttttaatttgtggttttgttgttggatgtttggtgttggtgttgagtttttggttttttgaatggagtgtgatgaataatggggttggggagtttttgggtttttttttgaagtagtagtgaagttagggatatgttggtagtaggtagggagagggatgtttggtttgtgtttggagttagttgttttatggaggagttgggtgaggatgtggtgggaggaagatttttttagttttgtattttttgaagtataattgagtgtttgtgtggtttgggggttattttggtttgaggatagttttgttttgtttagttaggttttgaagagttattgggatatggatagtagttttgttgggtggtaggttgtttatttttgtttatttaatgttggaattggatgtagagtatttggatggttagttttagagtgtttttgatatttttagttattttattttttagattaggataagatgtgggattttaattttgagttttttatgggttttattttatgtgtttttataagttattgggtttattttttggttttagggttgtttggttatttggtattttggtttttttatttgtataatgaaaataatagttttagtttttttgaggagttataagatgttttttgtgtgaaaaattgggatttggtattagattatttggatttgaattttggttttattttttttaatttgtggttttgggttaatttggtttttttgtttttagtttttttatttatagagttattttattgagttgttgggaggatgaatataaggaagtgtatttatgtgtttagagtattgtgattttatttattattattaaatgaggtatataataagtgtttaatagatgtttagtgttattttatggattttgtgtgttttgtgtgtttttagtagttaagttttggaggtggggaagttgttgatgagttgtatgaggtaattagaaagaggaggttataggtgtaagggtttgggtgatatttgtggatagagagaggttgatggattttggtagaggggaagggggtttttgtatatagaaaatgttttttgtatttaagatttttgtgattttggaatagaggtagtagaggtttgtaaattttaaattataaatttagaaagtatagaatatttgtagagaggattagaaatattatatattttagtgtgtatagaattttttatatagttaaataaaagtatgtttttaattgaagttgttggagagtttttgaggattttatattagataagggttggtaagtggaagtttaatatgtaggagttattttttttgtttataaatgtttgttgttttttttgtttatatttgtatttatgtgagggtatttataggtttattgtttagttttatgttttgtttgttattaaaaaattttttaagaattttttagttgtaaatttttttattggagggggggttttaggaatttagttttgtttggggttggggtattttagtatttgttgtataggtgttggttattaaaggttatgtgttgtatttgtgggtttttggggtttggtggtatttgggtatatagtttagtggtggttttttatttgttagatattgggagtggggggttttttatttttgttttttggtggtggggggagtgttttgagttgttatatattagaatttattgatttatatgttgtggtattttatagttttttgatagttttttagtttgagagattattaaattgagtttttggagagggtggttgttgaggtttggatataggtgtggataggatagttttgttttattttggagttttgttttggtttagttttttgtgggtttgaagtttaggttgggttagtttttgttttttagatggttggaaaggtagtttagttttatggtttttttgttaggttttgagagttgtttggtttttagttttgtttttttttttttttaagatggagttttattttgttgtttaggttggagtgtagtggtgttattttggtttattgtaatttttattttttgggtttaagtaatttttttgttttagttttttgagtagttgggattataggtgtgtgttattatggtaggttagtttttgtatttttagtagggattggtttttattatgttggttaggttggttttgaatttttgattttaagtgatttgtttattttggttttttaaagtgttgggattataggtgtgagttgttatgtttagtttttagttttgttttgatttttttttaaggttgtgaggatgtttatgtttttttttttttttatggtttattgatgtttttagatgttttgtaaagttattttttttttgggagttttttagttggtgatgggggattttttggggattattgtttaggtagttatgtaggtttgtgggttgtgtttttaggttggattgagatttggtgtatggggtgtttttggtttgagttgaggtttttggaagttatagttaggaggtagtaagggatggttgttatgtttttttttttttgttttttagggtttttgtgggatagatttttttgtttgagttttttggttgtttatattttggttttttaaagtttagtttgaagttttaggtattttataatttgttttttttagtagtttgttttgttttttttttgttgatgtttttgaaatttttttgtttttttttattttttggttagagagagattggagattttgtgggaatttttgaggggagggagaaggttgttgtttgaatggaggtggtttttttttttgtttttttttaggtgggttatatttgtaggtttagttttttgttgtggtagtgtttggggtgttggttgttttttgggtatgagttgggagttgagggaggtgtttttaggattggagtggtaatttagttggaggaggagtaataggtttgtggttagtagtagttgttgtagggattttggtgttgtatttgtgttttagttgattttttttgtttttttagggtgggttggggatggtggtttgttgtttagtttaggaagaagaggggttgtaattagtagtagttattttaggggattttagtgttgtatttgtgatttagttgattttttttttttttttagggttggttgggaatggtggtttgttgtttagtttaggaggaagaggggttgtggtttttattttagaggttttttttttggttttttttttggtgttggtttaattgtaggtttgttttaggttgtgttggtatttgttgattgatgtttagtggatgttgataggagagggttgggatggggaagtagtaagttttggttattgtgggtttgggttatagatggttgaggtattttttggttatttttaggaagtaaggttttatgtagtttttgatttatttattgtttgtgtgtattttaggaggttgtattttttaaggtttttattaggtaattttattgggttgggtgttgttgtaaaattatttattgggtgtggtggttttttggtggggggtatggttggggaggatgtggtggaggagaagttagttttgtggttggggggagggtggattatttgttttttgtttgttttttgaattggagtttatggttttttttttaggtgtttgggttatggaagaggttatagttttgttttatttttgtggtagtttaggggagttttggttagttttgtgttttttgggagggtgatagtttggttaggttgtagggtaggattggaatgtagatttttgtttggttatgttgttgtttggttgttttgtttggggattttttgtttaggaagagagaagtgggttggatagtttggtttagtgattggaagtttagttttttatgtttagtttagtaggaagtttgtttttttggaatatttgtgtgtttttgtatgtgtttttttggttggtggttttgtgaggtttttattgggttgtgttatgttttttggttattttggttttggtgtttggtttttgtgaaatagagatatttgggtagttttttatttgtgtttgtaagtttgtgtggttttagtgatggttgattttgttttatttagaggatttgggaatttttagtttaattgtttagaggagttttttttagtggggagagtttgagttgtttttttggtggatagttttttagattttaggtggatttttttgttggttgttttttttgttgtttttgtttttttgttttttatttgttttttatttttttttttgtagtagttagttggtatggggatttttttttttttttgggattgtgaatgagatgatttttttggtttttttgggtttagatttttttggtaatagttagtgaaatttttgttttaggtgggaggagaaggtttagtatgtggttataataatggttttaattatattatttttaaatgttggtttttatttattttttgttttgtttaatagttatttttattattttattttttagattaggaaattaaggtgtagagagttttagttatttgtttgaggtttttatagttaagtgtttggatttgaattttggagtagtttggttgttgagttgttttggagatggggtattgtgtagtggttggggtaggggtggagttttgttgttgttgatttttgggttatttggagtgataatatagtttagtgtttgggtttttgtttgagattttggttggatgttaggagtttgagattttttagtttttttttgtgtaaggtgttatggggtgaaatgaaagaaaattttagttagaaggtgtttttttttttttttagttttttagttgttttggattttgaaataagatattgtttgtttgtggggtgagtaggaatagattggaattgtatttttttttttttagttatagttgttaggagtttatttttttttgttttttttttttgttgtttttttttataagattgggttggatgttgttgggaaagttaataggaagttttttggttgtggtggaggtgggggtttgtgtttttttggggattgagatgagggttttaggttggttttggtaagagtagggaggtttatgtttttgtttgttggttttgttttttgttttgggagaaggtatttatatgttttagaatgtattttttgtgtgtatagggatggtttttgggttatttatttgaggtttattgatttttttttttggaattggagtggtttttttatggtggattgggttgagttttttgttttggttgatgtttttttttaggtatttttttttattgtgttagggtgtaggttgttagtggatgggtttttatttttggggattggtagttgttatgtttattttatagttgagatattttggttgaaggttttgttaagttttatggagtgtagggattttttttgagatggtttttttttgttgtttaggttggagtttaatggtttaatgttttgtttattgtgattttgattttttaggtttagtagtttttttattttagtttattaagtagttgggattataggtgtgtgttattatgtttggttaattttttaattttaatttttttttgtagaaatggagttttattatattttttaggttgaattttaatttttgggtttaaatgatttttttgttttggtttgttaaagtgttgggattttaggtatgagttattgtgtttagttggggtttttttttaattttttttggttttttttaggtgtaggatttgggttttagttttatgtgtttttgaatagttttgggttttgttttgtattttttgggtgtgtggttaggttttttgtgatattagtaggagatttaggtgaagaagtaggtagaatggaatgtttgtttatttagttttggggttaggtggggtggttaggatagtagtagtggttggtgtggttttttgggaggttagtttattggtgtggttagtgaatggggaggggagtttttttttttgtttttttttatttttggtttttgggtttttagggttaggtttttagagttttaggtggaggatggaggttagggaagttggggtaagagtgggttgggggtgggtggttaggtggattttggaaaattattttttgtaggttttgttttttttagggagtatttagggttggttttggggagttgggttaatggttattttggatggtgtaggggtttatttttatgaaattgggtttatttttatgaaattgggtttatagaagtttttggttttggttttgttttgttttttggtttttgtttttaaagtaggatttaggatagttttgaattttttgttgaaatgtagttttttgggttttaatttagttttttagaattagagtttttggggtgggttttttgtttgtttagtagtttttaggggatatttgtgtttgttagagtaagtttaataagtattgttgtaaattttttgtttttatagttttttggtttgtttttttttttttgttgggatttgtattaggattaaatgttaatattagggattaggttatatttgtgaattttgagataatatttgtattttttttttttttgaggttgttttgtttgttttgttatttaggttgaagtataatggtgtgatatttatttatggtaatttttatttttagggtttaagtaatttttttgttttagttttttgagtagttgggattataggtttatattattatatttggttaatttttgtatttttagtagagatggagttttattatgttggttaggttggttttgaatttttggttttaagtgatttgtttgttttagttttttaaagtgttgggattataggtgtgagttattgtgtttggtttgatatttatattttgattaagttgttgtggaaatattgagttttttttgatagttttgtttatagagtgaatgtttaggaattggtgaggtattttttatttttatttagatggtggtttggaggtagtgtttttgattttgtgatgggatttgttttttttgtttaagagattttagagatgtggtttttgaatgtgggggtttttgttggggtgggaatgggagttggttttggttattgtttagtgattttattttagtgttttgattttagtatttttgattttagtgtttttttttttttggttttgtgtggagattatgtggtttgtgttgagtaattttttattgtttttgttgtgtttttgttgtagggaagtttttttagggagttagttgatatatttggtttttattatttgtttttgaataggaatgaaaggagagagtgagtaagaaagtggtaggaggtgggggttgtagagtaggggaaggttagagagaggggaggaaagatttggaaagtttaggtatgtgttttggaagtaggtgttagtgatgagtttatttggagggtggttgtttgttttgagttttgtttggggttagtagggaatattttgttagggtatgttgttgggagtttgtttttggtttattttttgttgttttgagtgttgagtagatttgtttttattttagggataatgtaaggaggttgttattttattttttattttattaatattttatgaattataagtgattatttattgtgttttgatgtattttaggtgttgggtttgaagttttatgtgttttatgggatgtatttgtattattgttgtagaaaatggtttttgttattattgtagagaaggtattgaggtatagagaggttgaggaattggttttaggttatatagttagaagtggttgattttggttgtgaatatagggttgtttgattttaaagtttgagttggtttgtagtgaggtttatggtttttgtgttattgtttgagtttttggttgagttttttggtttagtggggggtttagtgatttattagttgttttattatatgttgtggatatttttatggtttatttgggtgggagggaaggggttttaggaggtgggaggggtatagggaatatagtttagtttgtttgggtttaatattttgatttttaaggtattttttgagggtagtatgaggttaagtttttgtttttttttaggattttgtttttgtgagggttttggggttttttgtttttttttgggggttttgttggttaggattatagagaagttttttgttgttgatttttttgtttttgtattttttggtaagttattttatgatttagttgttttgtttgtaaaatgggttgaataatattgttttgttttggagggtttttgggaggattaaatgagatttgttgtatagaagttttttgtaagttatgttgattggtggttgttgggtttttaagtgaatgggtatttgggtattgagtgtgtggatttagtatttggaaggaggggttggggggtatttagaatttttgggaggtttggatttttgttttgtttagattttgagtttttttttggttagtttaatttttattagtagggtgagggtaattaggatttatgtatagttgggtgaagttgagtgattatatgtggaagtttagtgttttttatgtaaagtgggtaggtggttaaagtgagttttgttttagtttttttatttttggggttgtttttggtgttttgtttttttttagagttttattgatttgtattatgtgatttgggtttgggaagatgggtttagttgtgggaggttgtgtgggttggggattgagagtgttggaggagggttttttaggaaaatttagttgtataggaagttgggttagtggtttttggaagtttttgggttttgtaagttggattttttagatttgtggttgtggggtttttttttgtttgtagttgagagtttttgatttgtatttgagggttttagaggtttgggagggggatgtgattgtgtttttagggtgaagtttatttgagtgttattttggatatagtttttatttttttttggttttttttttggttatggggatgttgtttggggggggtttttttatatggaaggagttgtagttgagttggtgggttttgtatatttttaaggttgtttgatttttagtttttaagtggggttgtatttattatttaggatttggagttttagttagagagggattttttattgtttttttttttgttttttgggaaaggtagggtttttgtgtttttttttatttagggatttggtatgttgggaggttaagaggaagttgttttttgtttatttattttttaatttttttagttagtagagttttatttgtgtgtttagaatttgtgtgtggagttagaagttataaggttggtttagttgtgtttgattttggttgtgtggttttggatagttttagtttttttggagttgagtattttgatttgtagaggagaggttgttgtgttggttttgtagggttttgtgtagaggggagtgtgtgtggttgtgagtttaggttatgtttttagattggaggataggattggaatagtgggttaggatggttagagggttttagttttaggaggaggtttttatattttttagtatttttatattaggaaatgtagttaggtttttaggttttttatgttaggaagtagtattttgttttttatttttggttgtttgggtttgagaagttgagtattttttttgaatttgagtgttttttgatttttgtttgggtagttgttttttttgaattgattgtttgttttatatagttttttgtggtttgtttgatagggtggttagtgagttttttgtatagtatattttttttaggagtgttgtttgtgatgatggtgtaaagggtgtttttttgagtttttggaggtatgtagtggtgtaatagtgtgagtttaggagttttggtgagtttttggatggagaatttgtttagattattttttagtttaaattttttttgggtgtttgttgtgtttggggtgttgatttattgtggggtggtttgtgagattttatgttatttggttattttttttagtttttgtttattgtattggttttttggtttggttgtttttggaatatgagggtttatttttatggaagaatatttatttgtttttttttggaaagtttttttttagattttttggttgttttatttaggttttgttgaagtgttgttattttggagaggtttttttgttatttgtagttaaaatagtttttttatgtttgtgggtggttttttatggggtatggatgagtattggagagttttgttgtttatttgtttatatgttttttgggagggtaggggatattgatttgtgttgtgggtgttttgtatgttatgggtgtttagtgaatgtttgttaagtattaggggagtataaaggagggaagtttttgtttaattggagtagttagggaagattttttggaggaagtggtatttggtttgtttagaatgtggtgatttgtttgtatgtagatattagattagagggtaaaggttattattataatttagtagatagttataagtagttaaggaattgttatgatatggattgtttgtgattggagttaagaaggagttagagatagaggtttttgtgttttggtgtgagtttttgggggaggttgagtttttagaatgtggggttgtttgtgtagaggttggaggtgggagatatatttgtgagtgttggtgagtgtggggtgagttattggggttggattagaagatgggaatttttaaatttattaattagttttggtgttttgggagtgataggagatggggtttttgggggattaatttagtataagtggatgagatgggatgtaggggaaaggataaagttttttgaggttttgggaagttgagttagggtagagttatgatagggtgagttttagaagtaatataagaaaaaatagttagattgggttttttttttattgtgggagatgttttattttattttttttgttttttgggttttggtaatgggttgggtatagtgaatgggttttatttgtaggagtggttatattttttgggtatagttgttttatatattgtattgagatgggatttgaggttgggaagaatagttttttttgtaggttgatattgttagtttttggggagggaaggatggtagggggtttggagtatttttttttgttatttatattttgtgtttgtttgtagggttttgagttttgtttgttttgttttagttttggttaggaatttgttggagtttataggggtagttaggttggaataggaggagattaggttggtaggggagttgagagggggttttggatagtatttagggttgagttattttgggtttgtttgatttgttatttggagttgtttttgtttgtttattatgtgtaaggttttgatttatttgggtttgtttaattagtgtttttttttaggtttagttagtttggtttttgtttgatttatttattgttattagtgttatttttgtattatgtaattagtttttgtagtatgttagttattaagtttagggttttttgtgtattttttgtaatttttatagtaatttgggaggtatagagaggttgagttgttggtttatagttatatagtaggtatggggtattgttaggatttagttggatttttgattttagggtttttttagggttttgggtgggatattggtaaggaagtaaggtatgaatattggttttgttttggatagagtttggggatggtggtttggtaggtttagttgatatagtgattttggtgtaggtttaattattggtaaagtgtttaagtatatatagaattttaattggggagataggtgaagtggttaagggagggttgtgagtgataggtggatattgtatttattggtagattagttgattttggtgttttttggagttttttaatttttttatttagaaaaagaggaattaatagttttatttttaaattgggtgggagtattatatttgaaattgaagtaaagttggttgtgttataggtttggtagatgttagttgtgtaggtaatttagtgattatttgaagtaggttgtgtggtggtatttttattttgtagatgtagtttagagaggttagggtattaattttgggttatatagtgatagtttaggttatagagagtagtgttggatgggagggtgttggtagttttaggtataggttgggagggttgtggggttagtagagggagggtatattttttagttggtggggtttttttgtgttttagtatttatgtgggtttaaaggagttggaaggagggaggttagagttatttatgggtttagaagttgataagtaggttattgattttgaatttgttttattgtatgtaaattggggataaatttggggatttaatgatataatgtaagaagtagatatgttatagttttggttatatagttagtgtataataagtggtaagttgttagaggaggtagttggtgagaatgggagtattttagtagttttttgttttttgtttttggttgtagatgtatttgtttttggttatttgtgttttagttttgtgttttttggtgtgtgtgaggttaagtttttggggtggggatttgggggtgtgtttgtagtttttgaggttaagattaaggttgaggttgaggttgaggttgaggttattttggtgaggaggaaattgtaggtggagaagtttgttgattgtgattttgatttgattgtaattttgatggtgttgatgttgttagtatgtaggttttttgtttttgttatgattggtttttgtagtttatttggttgagaggtgtgttggtttttgtaggttgtaaaatggggatattattgtttgtttgggttatagtgtgtttgttgattgtatttggggagggattgagggttgattgtgttgtggggatgttggtagagaattagagagggtatttaaaaaggttaatagtttggtggggagaggaggtgtaaggttggtttttgttttttgggttttgattgaaagggaataggggatatatttggggatagttttttttttggaggaagaagggtttagggtgttggtgtggagtttgtatagatggggataatgagttggagggtgttgggtaggagttggttagtaataggttgatgagggaggttttgttggttgggtttggtttttaagtgagtattttgagttgtggggatttagggggttttagagattttagagttgagatttgggattatagaggggtgggttgtgtttagggtaatatagtggatggggtagatgttgtgaaatttgtttttttgttttttttttttttgttatagaattggatttttttagtttatggttgttaaattttttagatgtttttgggttttatgggtgttttatattggtttttttgtaggatagtagattttgggggttggttttgatggtatttattatggggtattttatgtaagtatagtgtttttatgtttagttttttagtttgtggagtaggtttgtgtttggttagttttattttgtggttagaggagggagatagtggttttggagataggagttggtttggggttgtttttttagtttttgtttttttagtttatttttttgttttgtgggtgttggttattttttttttgttagttttatttttagttttttttgtttgagttgtgatttgttagtagggggtagtggaggttttgaaagtttttggagaggattttgaagtagtttttataaatttgtttttggaaagttttttttgttatatttttagtggtttttttttttttaatattttttttggggttgttatgtagtggggggtggaggaatttattaggttgtggatagagtagagttatgttgatataaattttggttgaatttatatgttttttatagttagtggttgattattggaattagggaagtgattttatagtaagggtttgtagagtagttattatgtatttttgattttggtttttggatttagttttggaaaagaagttagattttagttatttggagttgtttagggaagattttagtttggtgttggttgatagtttattggaattttttatttgtttggttaggtgatgttaaggggtagaggttagaagtgttaagaagtaggttgagggtggtggtttatgtatgtaattttaatattttgggaggttaaggtgggtgaattttttaaggttaggagtttaagattaggttggttaatatggtgaaattttatttttattgaaaatataaaaattagttaggtatggtggtgtatgtttgtaattttagttattttggaggttgaggtaggagaattttttgaatttgggaggtagaggttgtagtgagttgagattgtgttattgtattttagtttgggtaatagagtaatattttgtattaaaaaaaaaaaaaagaagaagaataagaagtgttaagaagtatttgtttttttgattgaaaagtaatttttgttgggtgtggtggtttatgtttgtaattttagttttgggaggttgtggtgggagagttgtttgaggttaggtgtttgagattagtttgggtaatagaggtgttaggggtagtggtgtttgtttgtagttttagttttttaggaggtttaggtaggaggattgtttgagttaggagtttgaggttgtagtgagttatgattatattattgtattttagtttttgggtgataggatgagattttgttttaaaaaataaaatataaataaaaaattaatgtttattttttgtgattttaaaaattatatttatttgtgataaaataattaaattagaaaatgtaaaggaaatgattaataataattgtgttttttagataaatattgttaatatgtttatgtttttttttagtttttttttatatagatatttaatatttattaatttgttttgaattaaagatggttttttttgttttgtatgagaattattttagttaggtatggtggtttatgtttataattttagaaagttgaggtaggtagattgtttgagtttatgagtttgagattagtttgggtaatatggtgaaattttatttttataaaaaaatataaaaattagtttggtgtggtggtatatgtttgtgtttttagttttttaggaggttgaggtaggagaatagtttgagtttgggaggtagaggttgtagtgagttaagattgtgttattgtattttagtttaggtaatgggagtgaaatgttgttttaaaaaaaaaaaaaaaaaaaaaaaagttgttatgttgttattttttttagggatttttattttttttattttttgtttaagatttgttttgtaaaaggatgaggttaaatagttatgggagggtggtattggatgtttaaaaaaatgttttgtggttggtgggatttagaaataggttggggaggttttagtagagggtggattttagttgggggtggggggtagtaggggggttttttatatgttttttttgtgtgttttatggggttgtttgtgaggttgtgtgaattagagtttggttgggaagttatatgttatttggattttgattttttttggtagtatgattttagttaatatgtttaattatgtttttttttgtaaaatgggttaatagaaatgtttatttgagatatgatgagaaataaaggtgtttatagagtaaagtgtttagaatggttttggtatgataggagtttatatgttagtgttgttgttggtattgttattattatggtggtattggttgttttgttttttttttgtttttgttattttttttttttagtaggtttttatttatttgtttatttatttatggttgaggttttgtttgtgttaggtttggtgttgagaatgggggtagagagatgggggttgtgttttgttttttgatttaagggttttttttgtaatgtgaagtttttggagattggatttttaggttgttttattagtttttttttaggttagtttaatttttttgtgtttgttttttgagttgttagaggaagagagtgggaggaaggatggagtggggtttttgtggggattgagtggggggtgtgtgaggttttggaaatggtgtttgtggtatttatgtagtattagtttttgttgtagttgttgtttggagaatatttttggattttaggatattgatgatagaaggtggaatgttttttttggaagttattaagaggggattattgtggtggttgagtagagttgttgatttgtgagttgtggtttgattatagttattgtttttatgagtgaggttttttgtggttttttttttaggaatttttggttttttggtaggggatagtttagggttgggggtgggtagtggtgtttgtaggtttttttggagttagagaattttttgttgttgtggtggggttgtttttttttgtttttttttttttgttgtgtttttagttgttttgataggatgtttttggtttgagagatagaaattttaattttgaatggttttagtttttaagagaatttggagtttttttgtgtaaaatgagatgttttgagtattgaggatgttgtgggggattttttattttattatttttagttgtggtgttttttttggttataggatgttgtagttatgttgtagggaaggagagtttttttttttgtgagtttagggagtttttttatgtagtttttttattggttattgtttgagatttgatttggtggtttttgttttaaggagtagaaagggggtttgttaggttagggtggggttgggtgtgaggattttttttggttaatagggtttgtttaggtgtttgttttgttggggtagtagggaagggatttatatgtggtattgggatatggagaggtttttgtgtttgtgatggttaaaagggatggtgttttagttatgtttttatttattttgaggtttagtatggttatgttggaaatagtagtattgttttttttattgttttggtttgtttttaataggttagaggggtggggttggagtgggtgtttgatttgtggttggatttagttgtttgtggataggttgtgagtgaatttgtagaggaagggagatgggaatgttgggatttttttttgtattttttgaatttttgttttttgtgagttagatggggagtgtatttttgttttttttttttgggtattttttgtgttttttgttttaggtatttgatgttgtttgtttattttttttttttgttttttttgttggttttttttatatggttttaattaggattttttgtttgttggtggatgggtagagaggggagtttgttgtggggttttttttgattgggggattttttagtatagagttttttggtttttgtagggatgttgtgtgtgtttgtgtgagtttggtgtgttagaagtgttaagttgtagttgttttgtgtgttttttatattttttattttttaaaggttttgggtttggtgtttgtgggttggggatttgtgttggggtttttaggaggtttttggtgggagaggtagggtttttttttttttaatttgggtaattttgttttggtttgttgtttgtggaaagtgttttaggatatggtggtaggattggttggggttttggttttaggtttagttttagtttttgttagatttattttttttgtgtttttgtttattttgtttatttgtagggtttgtaggagtattttgagagttggtagggtggtttgtttggtgtttgtatagggtttgttggtgggtggttgaggttgtggtgaggtttttatggtttttttgttttgtatattttttttttgttgtgttgttttgttagtatatgagtttgtattgtttttgagtttgtagtttgttttttttattaggtggttaagtagggtggtagttagggtggtagagttttattggtttgtaggggattttttgtgggttgtaggtagttttttgtggttgaaggtgttttggtaggatttgtattatgatttttgttaaagtttatgtttaaggtatttgtgggtatttttgttttagatgtgagggttggtatttttttttgtatgtgaagtaaaggtttgtttgaaggagtgtgtggaagtttgggtgtgatgaaggtaaggattggtggtttattttttttgtatttggattttgggtggtaggtttggggtttttagtttttaatttaggagggtagttagttgttggaattaagagtgaattttagttgttgttgttatagttggagggaagaggggaaaggaggtgttgtaggggagtagagattttattttttttttgttgatattaggttgttggtgttggatggggttttggtaattgtggtaggagtggtgatgtttgatgatggtaataagggttttttgaggattttgagttgttttaagggttttttatttggagtaagtattttttttaatttttttaataatattgtgaaattgattttgttgttatttttattttattgatgaggaatttatagtttagagatgttaagtaatttgtttaagtttttttttgagtatggtagagggagggtttgaatgtggaaagtttggttttagtgtttttatttttaattattgttatttatttttttggttagttttttgattgtaaaatttgaggtttagaggagtgtagtgatttggttagttttgtatggtaggttagtggtagagttgagtagtgttttttatgttttgattttgtggttttttgaggtggtttatttttaaatatgttttttatggtggttttgttttttttttttttttgaatttgttagtttgtgtttaggtagggggagaagtagagtaattatgttgggtgggttgttgtgttttagtgttgtttgttttatatttgattggtagtagagtggtttttttttggtgtggtttggaggtgttagtggttatttattagtatagtttagttttatatatgttatttttaaaggatgttgatatagaatgaagtagttaggggaggtggatgttttggtatgagggtggtgtttttggtaatttgtagtgttgttgtttgtggttgtttttggttggtattttatttttttttggttgttttgtagttatttgagggaggttagtatgttgtttttattttaggatagtgtgaatgtagtagtgtaagtttgttagtgttgtattgtgggatttggaggtttttgtttttgagttttgtttttgtgtaatttttaaagtatggattttttaggggtttttatttttttatttggaaaaattttatattgtttagggtttgaggtagggttagagtatggagatgttgttggaggattaagggagaattgagtgtgtgtttttttggttttagttttgtgtgtgtgtttatgtatgggtattttgttatttatattggtttttatggttgggtgggagttgagttgagtttggtggttgtttttttattttgtgggtttggttggggagtgtgaggatgtttgttggaagttaatgtgtatgaaagagttaatggtggattttatttttttagttttttttttagtttttttagggaaagggtaggaatagagaggttttatttttagaggaaggggtgggtggggatatagtgttgtttggtatagttttttttgagttattttgtatgttttattttattgatttttgtagtttagttgtttagagtggatttagaaggtggagagagggtttttaataagtagaggatggagtgaatgtgagatttattattgggatttggtaaagtaaagagttttattttttttttgtagatgggatgggggtggggttggagttagtggggtgggggtatttagtaagagtttttttttatttttttattttttttgttatgggtttttttttttatgtagatttttagtttggaatgattagtgtttagttttttttgttttttttttgttttgttggagggagtgatttggtttttggttttggttatttatattttttgttttgttgtattagttttgtggtaggggttgtggtggaggtgggtaaaagttgtttttgggtagttagtttttattttgggagtgattgaaagtttttgggggtttttgtagggtgagttgtttattttggttttggtaaggatatttaggagagggttagggtgtttgtatttggggtatagtataaagaatagttgtaagtgttttttaggtaggagggtgttgaagtattgggaagttgggatttagaagtattgtttggggtggtgagtggaagatgtaggatatagatttatgtgattgtgtagattatttggttttatttttttggtttatagtggaggaaattagaggttgagagaggtgaagtgagttttttggggttatatagtttagttaggtttagggtgttgattttttgttttgtttttttgtgtttatttggttggtattagtatttttgttttgatatttttgtgtggtagttgttgtgattttgtgatttttttttattttattttagtggggttttgtgagggaaagaagaatgttttatgtagaagtggttggaaagtaagaagtttggagagaagtgaggtttttgtggtttggtttgagtttaggatttatggtttggtttttagggatggagtattgattttttttttttatatttttattttatgtttttaggagttttttatggggaagttggaatggatttgggtttagagattgtaaatttattttgttggatgtgtggttgtttttatgtaattaatttttttatggagaagttaggggatggtttttagtatttttgggggttttttagtgaggtgggaggattttgagaggttaggaggttgtttaagattttttgttttttagggattaggtgagggtttgttgattgttttgattttttgatgtttttggtggggagattttagaggggtttgttgttattattgttagtggttttggtttgtttagttatttttttggggtggttaaattttatgttgtaaaagtttaagtgaattttagtagtggtttgggagaattatttgttatgagttaaggatggagtttttggggaggattttttgttgttttttaattttttttgggtatatttttttgtagttttattttttgtaagaaagttaggtgttttttgaagtttttttttggttttaggttagaggtgatagtgggggttttttgtttgtgttggtgattgtggttggttgttggtgtttggttttgttttgtattgtgtatttattgaaggtggtattatttgggtttttttggtggttatgtatgggtgagtagtttatgatatatttgtttttagtattgtgtgggttggggtttttagaggggttgagggtttggatggttttgtaggggggtgtttttggttttgtgattgaaaggagttgaaggtttggagaagttgttgggttgaggttagtttttatagatttggtgaggagggaatagatgtttatggagttgttttaggtattgtatatattgttttattttgtgttgatagttaagaggttggttttttgttgatttttattttatagataatgtgtttttttagttttttagtggtggagttaggatttgaatttatgtaggtagttttttgggtttgtagttttattttttatttttttttaggatttatgttttggggttggtaggataatgatttttagagttgagtatattttaatttttagtatttgggattatgttaggtgatatggtagggttagttaaggttattaattagttggttttaaaatagggagatgattttggatgatttatatgggtttgttgttattataagagtttttaaaagtgtaatagattatttgaggggtgtagtgggagaggtttggaaggaggaaggaggttataagttaagaaatgtaggtgaatagaaaatgtaggaaaatgtagttttttttgtagttttgggagggtgtgtagttttgtggatattttttttgtagtttagtgaggtggagtgtgggattaatttgtgttgtttgatattataagtgtgtggttatttgttatagtagtgatgggaattgaatgttattaggtagtagtgtttttattttggaagaattaggataaatttttttgtggattttaagttttgggagattttgggtttttttggattgttttagttttgtaattataggaaaggttttttatgtttgtttgggagaagaaaattttgtagtaaatttatttttttttttgataaatgaaggtgagggtgtgggttggatatatgttttttttttgtggattttttttgttttaatatttagaattttgtagttgaaggagattttggggggttgtttgtttgatttgtaagtgaagaaatggaggtttagggaagttaagtgattggtttagggttatgtagagttatgttggaatattaagttagatagtttagtttttgttttaaagtgtttttttttttggttggggaggagggttggagggagtggattttgagtaatagtagtattggtaggggttggaagagtagttattgtatttaggtgttggagtttttggttattttttgtaggaattaggtgatttattatggtataggtttttttttgtttatttgtagttttgggggttttagggattagaggatattttggtttgagggttggggtttgagagaagagatggaagtatttttagtttggtttgtttttgtggtgttttgtaggtatatttggtagtttaggggttttagagaatttggttggtgggtgtttttattttgttgtagttgtattttgtggttagtagtttgtaggatttgggttgttgtttgtggttttgaaatagttattttttgagttgagtggggattaggtgagtagatttttatattttaattgttgtgatttttttgttttggaggttggtgggtagtttggttggtgttttatggtattttatgattggttttgttattaggtttgtgagttgtttttttttttttgggtattttgaatggtttttttgagagttttgttttgggtttttgtttttgtaggtttttgttgtttggggtgttttttttttttggaagttgggtttttttggggatttattaagaagggttttgttgagtgttgttaaattgttttatttggtttttatttgttttatttattattttattttaatttttatgttttttttttggttttaagatttgagtaggtagggtttgtgaggtattttaggttttttgatgttgttagtatttaggggattgttagtatatatgtagggagggaaggaatgaaggaagagatgatttggggagttttttagtttttatttgtaattggtatattgtgataaaatatttatggtattttattttttttatatattttttttttaaatttatttttatttgagatggagttttgttttgttatttaggttggagtgtagtagtataattttggtttattgtaatttttattttttgggtttaagtgagttttttgttttagttttttaagtagttgggattataggtgtttattattatgtttggtgaatttttgtatttttagtagagatggggttttattaagttggttaggttggttttgaatttttgattttaggtgatttgtttgtttttgttttttaaagtgttgggattataggtgtgagttattgtatttggtttttgtatatttataaaagagaatttgtttagaaaattttttagatgtatttttagggttttaaggtatagatatatgaagtttgttagtgagtagttgttgtttattttttttttttttttaatttagagtggtttgtgttttaagtggatagttgtttttttttttttggttttttgttgtttatgtttttatagaagtagggagaagaggtaggaaggtgatgtgtgattatttgttgggtgtttgtatagtgttgtttgtataggtgttattttttttatttgttattttttttgttgagtttttttttttttttgtagatgagagagtattgttttttagaggttaagaaatgggtttagagttatttagttgattagtgtgtagttagatttgaattatattttgttgatttttatgtttgtaggtttggtttgatgagatggatagttgggtggtggagattttgagattttggatggtttttaaatagggtttgtagtttttggatagggagagtttggtataaagggtttgtggagtgagttgggggagaaggtggtttagggtttttgtttttgaataaatagatggaggggttattttagtgtttttttagtttttggtgtgttgggtttttggttttgggaggagagaatggagttggtttttattttgggttgggttggtttgggtttaatttagataagttttttagtttgttatgagtgatatttttgtttgttttggtgtttttgttaaaaatatgaagggttttagaatttttattttggtttgttttttttttagatttggagtgggtttggggttgataatagttttatgttagatagtttgagtagttattagtgttattaggtttgatattgtggtttttgttttggagggaaaaataaggttttttttgggggattttttgttagtttgtgaaaataggtttggagttagttagtgtttttatgtttagatattttgtgtggtttttaaagtgtttttatgttgttagtttatatgattttttttaaaattttataagggagggtaggaagtttgagtaatagtttgttaagtatttatatagtaggtggttttattgttttttatttatagataagtaaattgagttttagggtggttattgtttgttttttaagttatttagttatttagttatggaagaggttatgattttttatattttagtgaagttgaagatttttttttttgtttttaaaaatgtttattttttagggtagtgaatatttggtgtttttgtttagtgtaagaggtgaatgtttgttatttttgtttttttttttttattagatttgattttttttttgtgatgggaatattttgtaggtagtttgttttgtttttatagattttgagaaatggggtttaaattgttggttgtgggtgggataggtgatattgtagtgaagaggtggagtatttttgtagtggggaagaaatatattttttttatttttttaggtttagtgtttgggggtttgtgaattaaatttatttaagataaattaatgagagaaaagatagatttaattatatatgtatgggattttattgaaaaatgtgatttaaaagagtaggtagaaggtggggtttgtgattggtttgaaggtagtgagttattttagttgattgtttatagttagttatagattagattttttgttttattgttttttttttttttatttgttttgttttttttgagttagagttttgtattgttgtttgggttggagtgtaatggtatgattttggtttattttaatttttgttttttgggtttaagtgatttttttgttttagttttttgagtagttaggattataggtatttattattatgtttggttaattttttgtatttttagtagagatagggttttattatgttggttaggttggttttaaatttttgattttgtgatttgtttattttggttttttaaagtggtgggattataggtatgagttattgtatttagttaattagttttaaaaaaaaaaaaaaaaaaaaaagaatttagggtttgtatattattttaataggaaaaaaggaaggggtgaaagtatatattatgggttgggtgtgatggtttatgtttgtaattttggtattttgggaggttgaggtaggtggattatttgaggttgggaatttaagattagtttggttaatatggtgaaattttgtttttattaaaaatataaaaattagttgggtatggtggtgtatatttgtaattttagttatttgggaagttgaggtaggagaattgtttgaatttatgaggtggaggttgtagtgagttgagattatattattgtattttagtttgggtaatagagtgagattgtgttttaaaaaaataaataaaaaaaaaaaagtatatattatggtaaaataaatgagtttttggaaagataaataggtttttaggagttgagatgggagatgtgaagttttgtgataatgtttttttaggtgtggtgtggaaattatttatattttttagggaagagttagttgtttttagggagtagatttgggtttgtatattattttaataggggaaatggaaggggtaaaagtatatattatgggttgggtgtaatgtgtttagtgtaggaggtagatgtggtttatggttgttgttgaaattagtgtagggtttgattgttttgtattgagtgttgaggattttggttttgtattagttatgagtttgtagttttgggatatatttgatgttggtttaaggggaaatgaggttggaggggtagggtggttggattggatgtgggtttggggttattgttgatttataaagtggttattatatgggaataatagagttggttatagattataattagtaatattatttaaaagtaaggttatatttttaataataagttatattttaagttattattaatttataaaatatattgttggtataatgatagttttttaagaaggatataaaaaggtatgttgggttgggtgtagtgatttatgtttataattttagtattttgagaggttgaggttggtggattattttaagttaggagtttgagattagtttggttaatatggtgaaattttgtttttgttaaaaatataaaaaaaaattagtttggtgtggtggtgtatgtttgtaattttagttatgggggaggttgtggtagaagaattatttaaaatttgggaggtggaggttgtagtgagttgagattgtgttattatattttagtttgggtaatagagttagattttgttttaaaaaaaaagaaaaaaaagaaaaaaagtaaaaaggtatgttgaaggtatttgtttgtggaaagttgtaatttgatgggaggtagggtgagtattttttagaaaggtggaaatgggtttttttgttatagagatttataaatatagattgaggtttgtagtttaggagatttaaaagaggtaaaggtgaataagagttaaggtttttaagttagggtttgattttgggggtgggggttatatatgatggaggatgttaggagggttttttggaggtggtgatatttattaggggggattttaggtggggtttgtgagatagtaggatttggttgaagagtgtaggttttttagataggagtgggaatttaggtttgaaaatgagttggttagattgtaggggtttttgaatgtaagggaagaattttaattttaatagaggagtttgggaagttgtttgggaaaaggagtgataaagtgggaggggttttttagtagagttttgtatgggtaggagggagtgagatgggaggtgggtgttggtaagggatgattttagtggtttaggggagtagttatagggtggaaattaattttgtggggtttgggtaggaagggattgatttgagatattgggaagaaatagttagtaggattttggtgagagggttgggggttggggaggggggtgtggagagtgggagtttgagtttttgaaaatagatagtgttttaagggggagatttgaggtaagatgtggagaggtagttgagttgggaagttggaatggaggtgtggttattttaggagattaagttagggggtgaggggatttttgggagttatttagattttagtattagggaatatggaggggagaaggaggggagaagaattagttggtgtgtgttaggtattgtttttgaggttagatggggtggggttggatattggttatgaggatttttttaagagttgggttaatagtgagatgggtggatattagatggtttgggttaagaagtaagtgggtggtgggaagttagaagttgtggtgtagatttattttgagaggttgggttgtttagatagggagaaagtttatagtttgaggaggtagataggttaaaggaagagggtttgtttgtttttgagattggggtattttgaatgtttttttaggttaagtgagaagaaattagaagaggaatatgttatttaaatgtgttgaaatagtttagtagttgtgttgttttatagaaaatgtgtagaggtttttttgttttattatgtttgtttggggatggtttttatttgggttatttagggtttttttagtttgttaatttaagggtggtaggagttgtgggtgtttttagtttttttttaaggttggtttgtgggtagaaatgtgggttgttttggggtgttatagttataaatgtatattagtttttagaattatatttttgttttttagtttttttttttgtatttttatgtagaagtgtggttgttagtttataaaggatagggagggatattgtttttggtatttgatgggaagtatttgttgtattttattggggtgttgtttaggatggattggaaaagagttggtaggaaggttgagttttgtgtttataatttggtttggtggtggttgaggagtttggtaggagtagagtgtaggatttgggaattgggggttggtgtatgtgtgtatgtatgtgtgtgtgtgtgtgtgtgtgtgttgggtgggtagggaggaagttgtgaaattatatttttttttttttgttgttgtgttgttgtgtgttttagtagtatgtgggtgttattatattttttagtaggtgttaatttttaagattgttttgggttttttttttagttggttgagttggaggtgggagttttaattgttttttgtggtttttagagtgggattttgttgtgggataggttggttaatggtgtttttttttttgtgatttttttgttgggtgggttatgaggaaggattgtgggtgttgtttatagataggtggatatgtggtaaggatattttgggattttttttttgatgttttttgaagggggtatttttttagttttgagatgagtttttgtggatgtgggaagtttattattttaagagtagtagttttggaaaatttaatatagaattttgagtaggggtgggaaggggttttgttttgtttattggttgtttggtagagttttgtataaggaagtgtttgtgttgttgtgggtggaggaatggattgagggttatatttgttttttgttgttgttgtaattgtttattataaatttagtggtttaaagtaatagaggtttttttttttatagtgttaagggttagaagttgattagttttattggattaaagttaaggtgttggtagaatttatttttgttttttttagttttgggtgggaggttttgttggagttttttggtttgtggttgtatttttttagtttttgtttttatttttttatagttttttttttttttgtagttagatttttttttgttttttttttttttttttttgagatggagttatttaggttggagtgtagtggtataattttggtttattgtagtttttgttttttgggtttaagtgatttttttgttttagttttttgagtagttgggattataggtatgtgttattatatttggttaatttttgtatttttagtagagatagggttttgttatgttggttaggttggttttgaatttttgattttaggtgatttgtttgttttagttttttaaagtgttgggattgtagttatgagttattatatttggtttgttttttttttaaaggatgtttgtgatttggggtttatttgggtaatttttttattttaatatttttagttatatttatagagtttttgttgttatatgaggtaatatagtttgggaagggagagttatttagtttattttaggggtttgtggtgtattttagggtttttttgattttaagatataaagtaagaaaataaattggtttaaggggaaaaaaggatatgttgaattttgttgttttaaatgtatatttttttattgtgttaaaatgtatagaatataaaatttgttattagtaatattgagtatatttatagtgttgtgtaattattagtattgtttagtgttagaatttttttattattttaaagggaaattttgtatttatgaaggatttattttttatttgttttttttagtttttggtagttattagaatgttttttgtttttataaatttatttttaataagtgtaattttgtgtgattttaaaataaataaatatgagtatgatgagttgtttattggaaggatatttatgtggggaggttggtgtgtggagtgtgtaggtttttggatgggtaggagttgaaggggtgtggatgtgttgtttttttttttttttgttttttttttggggttattgtttgagtatttttttttgtaaatggttttaaataatgttttagtttttatgtttgtattgttttttagttttaggattttttattaaaaaatattttaagttttagatttatttttgggaaaattttaatggttttatttttttttttgagttagttagattttatggtttgtggtgggttgtttttgagttttgagtatttgtgagttagggaagtaggataggtatatttagggaaggggaagagttgttgttagttatagtaattgatatttttggaattgtttaagagatatttagtgtgtgtttaaaatatttatttttttttttgtttgttttttgagatgaagttttgttttgttgtttaggttggagtgtagtggtgtgattttagtttattgtaattttttttttttgggtttaagtgatttttttgttttaattttttgagtggttgggattataggtatatattattatgtttggtgaatttttgtatttttagtagtgattgggttttattatgttggttaggttggttttgaatttttgattttaggtaatgtgtttgttttggttttttaaagtgttgggatgataggtgtgagttaatatatttggttatatttattttttaggagaagttttgtattttttgaaagtgaaatgtttttaggtgggtgatattgatggtgggatttgtggttttattagtgttttatgagagatgttgttgtgtgttttattaagttgtattttattgttttttaaatgtggtttgtagatatggtgttgagaatgatttgggaggtttaaattataatatggtttaaattaatagttttttgatgatttggtattattttaggattaaattgagattatttgaggatgggtgtggtggtttatgtgtgtaattttagtattttaggaggttgaggtgggtggattaattgaggtttgtagtttgagattagtttggttaatatggtgaaattttatttttattaaaaatataaaaagtagttgttggatatggtggtgtatgtttgtagttttagttatttgggaggttgaggtgggagaattgtttgaatttaggagatggaggttgtagtgagttaagattatgttattgtgttttagtttgggtgatagagtaagattttgttttttggtaattaaaaaaaaaaaaaaaaattgagattttttgagttgtattgtttagtatgatagttattggttgtatggggttatttgaatatttgaaatgtggtgattttaagtggagaggtgttgtgtgtgtgaagtgtattttgggttttagagttttagtaagggggaaagaaaagaatattaaatatttgttatttttatattgattatatgttgaattgataatattttgggttttgttaagtgaatgatattaaaattaatattatttgtttttatattttttaatgattttttttttttttttttttttttttttttttaaatatggggttttatattgttgtttaggttggagtgtagtggtatgattttggtttattgtaatttttgttttttaggtttgagtgatttttttgttttagttttttaagtagttgggattataggtggttgttattatgtttggttaatttttgtatttttagtagagatagggttttgttatgttggttaggttggttttgaatttttgattttaggtgatttgtttattttagttttttaaagtgttggtatgataggtgtgagttattgtgtttggtttgtttttatattttttattgtaggtgttggaaaatgtaaggttgtgtttgtggtttatgtgttgtttttgttggagggttggattgagggttagttgagaaggttttggggttgttttatttgaatgttgagtgtgtgttgagtggtagagaattttgagaagtgttgaaggatagaggttttgtgtgggggatgtagttttaggttggagatgttttttttgtgttttggagatttttatttggtgatagtaagaggaattattgtaagaggggtggttattttagtaaagtatttaggatgttggttttttagtttaggaatttagaggtagaggaggggaggaggttgggtttggaggagagtagggttttgggttttgggaaaagtttggggggttagaaagttgggggatagattgaggttagaggtaaagagaagaaggtttggagaggagggttaaggaagaagggttttgtttatggggagggagaggtttatggggtaggggtgtggtgggagttgtatttttgaggttttttgttgattttgatatttggttagaaaggagttttttttggtattttttgttagtggtttttggagttgttttttaggggttagtgatgagggtgttttgggttgggttgtagatagtggaaaagataggttttttttatttttagtgttggggaaattagttttttggaggaagggggagttgtattttttgagtggttgtattttttggtttagatgtgtgtgttttgttgtaattttggtgattggtgttggtggtgtttattttatggatggggaaggttaaattttatagatattgagtgataggtttagggttttggattttagtgtttgatttagaatttaggtttttgatttgttattagttttttttttatttagatgggaatagggattttgggtatgtagtttttttttagatatttttttggttttggtttggtgtttggagattagtagtagtagttttttatggttgtttattgtgagggtggggagggttgtgggattaggaggttttagggggaaagttggttatgaggagtgggaagtgatgggttagatgttagtgattgttggttggggagttgttggatgtggttggtttgtttggttagtgtggtgggtgttttggggttttagttatttttagttatgtgtgggggtgtgggatgggaaaggtaagagtgtgtggagtttagttagtatttaatatgaggttttgtgggggttgtttgagggtgtagtttttagaatttagtttttggtttttagaaggtgttattaaaggtttttttttatttgagtgaattttttttagtttttagtaagtttttggaatgagtttatttttaggtgtttttttttagtgtgggagtggttatgtttttgttgggagtgatttatttgggtttagaggttgtggtattgagatgggtttggtagattttagtgtttaggtttagtttttatagtgttagtttttttttttggggatttttttgtttgtgtttttttgggttttagtatattttaggtttgtagggagggggagaggaagagattgatttattggttaggttttttaggggttggagaggttggagaggtaggagttggattagatttgaatttagaggtttttggaggaagagtttagggtgagttgtgtttttattttttgtttttttttttttgtttttttttttttttatggttttagttagtaagtatttggggtagaggggataaatttaggtggttgtgttttagttttggttgtaggtttgaatggttttttggggtggttggttatgttttttgagagtttagttgtggtgatgtttgagtaggtaggtgggggagtatttaggaagtaggggtgttaggtagagtataaggagagagggtgtttaggttagttttaggatttggttgagaggagggggttttttatgggtattgtttttggtaagtatagggataagggtaaggatggtatggttagaggtttttgggagttttttttttttttttttttttagtagtttttttttattttttttagggattttgttatttttttttagtgtgtggtagttttttggtgttttttttgtgtttttaggttgtttttgtgttgggtttgttgttgggtgtttttatttttgtttgttttttttttttgttttttttgttttgtttttttggagtaattttttattgagtttttttttttaggtagttgaggtttttttttatttttgttttgtgttttgggaggttttttgttttgtgattataaagtttttttgattttttgtttggttttgagttatgtgatttggtgggtgggttgtggtttttggtgtgtttagtgtagtttgatgttttgttgttggggtgagttttgtttttttgttttttttagttttgtattattggtttgggggtttttaggtggtgtggttgtgaggtggattttgatggttatggtggtggtgttgggagttatgttgtttttgggttttggtttgaggttggtaggattgagtggggtttttaggagaggggtggtggggagtttgatttttatgtggggattagatttttggttttaaaatagaagaatagggttttgtgtggttatagttatttttttgtaaatatttggttaattaagttgagtggttaagtttttttgttgtttggagttttttggaatatgttttttttttgtaaggggtttttttggtttttaggagggttaggaagaaatttgaattggttattgttttttttaaaattattttgtttaagttattatttttttgggtttttgaagattggttggttggaggttggagatagttttaatgtttgaaatgttgtaattgaagttttttgtggtgttggtattgggatttagggagttgttgttatagtgtagttttggatttttggatgtgttggatatgtgtagggtgtttttgggaggagtggggagggagggtgttgttggtggggttggtttgtgtgtgttttgtttttttataatggtatgttgtgtgttggttatgtagaggtatgttagtgagtaggggttgagggatttttttaatggatttgtttttagagggtttttttatgttgggagaattttagagattaaattatgtagttaatggggtggtttttggttttaaagtagggaggggtgaggagttttgtaggtaatgttatttgtttttgaaatgttgttttagtgattttggggattgatttagtttttagtttgttgtattttatttttggtttttttttttttgtttttttatgtgaaatttgttgtgttttggttagaggtttggggaatagttttttgtttatttaagataagtttgtaattttttttttggagaaaaatatgttatttggaagtaggttgagtagtggttttttggtaggtttgtttggggttgtggagatagtatttgttggattaggatggagttggaatttggtttggattttatatgagaaaatttgttggaagaggaggaagtagaaaaaggttttattttttaataatgttgtgggttttttttttttatttattgttattttgttttgaaatttaatggggttatgtgtgtttttatgaatgttattttttttggttaatttttttggtagttttaggagtttttttttaggaaaaggaagaaggtgtttgtttagtatttagtatatgagtttttgttggaaaggtgggatttttgtttttttttgggttttttttaggttgagatgtggttaaggaaggtttgtggtgtggtttgttttttttaatgtttgtttttggagatttgagttgttgttgatttttagtttgttttttttgttttttggttatttttgtgttggggtggttgagatattattgtattggttattttgtgtttttattagtttttgtttttgtaggttgttattgtgatggtgatggggttaatttagttgtggtggggaggatttattgtgtgtgtttggggggtggtgtggggtattttgggatgagaagatgtgatttttgttttgagagttttgttttaatggaaggtgggggtatagttgtaggtagaagttattaagtattgtggttagattagtattttatgttaaaaatggttttgttggttgggtgtagtggtttatgtttgtaattttaatattttaggaggttaaggtaggtagattatttgaggttaagagtttgagattagtttggttaatatggtgaaattttgtttttattaaaaatattggttaatttgggtatggtggtgtgtgtttgtaatggtagttatttgggaggttgagataggagaattatttgaatttgggaggtggaggttgtagtgagttgagattgtgttattgtattttagtttgggtaataagagtgaaattttgttttaaaaaaaaaaaaaaaaagttttatttgggtttgggatttgttttttgaatattgggtttattgtgttttataaggatttttattttggaagttttagatttatttgggtaattagagtttttgggttgattattttttagttttggttagttttttgggttattgtatttttttaattttttgttgtgttatggttggtttaagttgtttttattagataatgtgaggtatttttataggaggggataattttgtttttaggagttttttttttttgtttttaggtttggtgtagtgtgtggtttttttgttggtgttaaaggttttaaggtttttttaagaagtttgttattattattagtagtttttgttatttggtttttttgtatatgtaagttttttttatatattttggatgtttagggtttttgttttttttttttggttgggagtgtgggaagagggttttattttaatgtttgagagtagggttaatggttagggtaagttgtgggggtttttttttgttggtttttttttgtagtttttattttaatatagagtattgatattatttgggttttgggaagatttggaggttgattattttggaggtttttagtgttttatagttattttttggggaagaggttttttgagggatttgtggtttttggttgggattttagttttagagttttgttttttggtgttgagttttgatttgtttattgagtgttagtttggtttttggataggtagggatttgtttttggagtttagtagagttttgggaagtttttttaggagggtttttgagggtggtggttatgtttagtttgttgtatgtgtgagtttgtttgatgaggaattggttgggaaggtgtgggtttaattataggtttatgagggttttttttgtttttatttaggaagtagtggagattttggtatatttagtatttgggtttgtgtttgtttagttgttggtggaattatgggagttttgttttggggtttgtagagtagtagtgggaattttttttattttagttttttttagagttggttgtttaaatttgttgttgtttagtttttttttttttttttttattaattttgggaattgtatattgtttattttattgggttttggagtgggtgtaggaagagagagtttaatatttagaggtttgggttttttgtaggtgtttgagttgttgtggtttgagttgggttttttgttggaattattatagtagatttaatgatttgtttgtaggagttgttttattttagttgattttggggttgtgggaaggggttgggttttggttttgttgggggtggggggttagtgtaaagggtttgaaaagtggtagaggtgatggtttatttgttttttttttggttggttggtttaaatgtgattggttttttttttttttttttttttttttttttttttttataaataatattaaatgtgatttgttaatgtatttatttgggtttagtagttggattatgggtagaagtattttagatttgttattttttttaagttaagggtggggaatattttttgtgagattttggtttttgagtgtttaagattgtttttggaattttaattttgggttggttttaggggattgatgttgatggagttgttgatattgatttttggtttttgtatggtttttaggaagggggttttttgttttttgttttgttgagtttggttggtagtattttttttttaggtttgtgtttttggtagggtttgttgtttttgttttgttttgtgggtgttaggttttaagtattaggtgatttggttattgaatggttattgaatagttatttttgttggtgtttttagtggaatgtgtatggatgtttttttttttttagatttttgttttttattttttagtttttgttttaggggttattataggattaggaggtatgtagatgtgggtggtatatttattgggtagatttagttttgaatttgtatgttttttttaagggggtttttagtgggtggggttgatggtgttgtttttttttttgttattagaatggatatgaggattgtgttttgttgatttatgttttgagtttttagatgttataggtgtttgtttaatgagtgtttgaatgaatggttagtattgtgtgattgtagatttttaatttttatttaaatagtttgtggtttttgtgaggttattttgagatagttttataagaatttttattttttttgtatgttttgtataaggtttttttggggggttttttagaaaaagggttaaagagtagtatttttttggggatttgaatatgattttttttggggtaggggattgttttggaagatttttggtattgttttttatgtgttatgtgattaggagggttttggggtaggatggtgttttttgtgttttgtgtgttggggttggaggaaatattgtttgtggttggtgttatttgttagttttgaagattaatgatgggttggatagtggttttattgagtgggagggagaattgttgttgtttgtagttggggggttgggtgggtgggagttgaggttagggagaatagtgtagatttggtatggagaggtttggaggaggagtagggggttttagttatttagggtgtagggatgttatatgaggagtaggtgtggtgtgtgtttttttgtgggttttttattttttggttttgttatttgtattaggttttgtggtgagagggtatagagtggaggaaggtgttgtggttagggtaggttatatgttgtgttaatggattgttgttatttgttgtttttgtggttttgttgttaggattttttagtattaggtttttattattaggtatgggttttataggtattattggttttttgaagttagggatagattttatagataatattgagtttttgtagttagggatgggtttttatggttagtattagattttagggattagtattgggtatttatagttagggataggtttttatggttagtattaggttttagggattagtattgggtatttatagttagggatgggtttttatggttagtattagattttagggattagtattgggtatttatagttagggatgggtttttatggttagtattaggttttagggattagtgttgggtttttatagttaaggataagtttttatggttaatattagattttagtgattagtattagatgtttatagttagagatgggtttttatggttagtattaggttttagggattagtgttgggattttggatgattgaaggagggtatggttgattaaagttgtaggagttagtttggttattttgaggtattaagttattattgtggttttaggggatttagatttttttatttgtttttttgaattttggaattagatatatttgggtttagtttttgtttttggggttgtgtgtttgggatggttgttttatttttttgaagtttagtgagatggggatggttgtatagggtttggtatagatggtatttgatggtatagggttatttgtttgtatttatatagttttggtttttgttttggttgtgtattgagagttttatgtttagatttttgttgagtttttaagtttttggttatgttttaggttttttgtgagaagtattattgtatggattatgttttgggattttattttgggttgggaagtttgttttatttttttaagttttttttagaggtgttttatgttttattatttttattgtttgaggggttagataggggaatttagtgtgggaggtttagaggtgttggagtagatgttaagtgagttttgtgtttatgtgttgggttttggtagatattttgaatgagttttttttttaggaaggagattggggttttagtttaagttgtggttttaaattttgtgattaagagtggagaaaaggtaagatttttttttttagttttttagaatagttgatagtggtggaaatatggggtttatattgaatttttttgtaatttgttgaagagaatttagtttatatttttaggggtggaggtttggttgatttggtagtgtgtttgtttttttggttatagtttattttggattgggtattttggtgtttttttttagtgatgtagtgaagttattatgatgtgtttagttggtgagaaagtgttttttgtaatgttttattttttttagagggtgaataagttttgtttattataaataattatttatagaatatatgaggtttaatttaattttgggttatggtagtgttttttgggtaaatttatgtgttattttagttagagtttgtgtttttataggttttttggatttattttgaaggggggttggattttttgtttgttttgatgagagggttgtaggatagtttttagtgagtttttttgagggttgtaatttttttttttggtatttttttgtttgttaggaatgttttaagtttttagtagaagtttatttattatagttgttttttattttgtttattattttttttgtttttatttatttagtagattttgtgtatagtttagtgtaggatttagggtgggaaggtgttttgggtgggttggagtaaggtttttagttagggtggggttttaaggtgggtttatagttaggattgtgatttgggaggtttttttttgttttgttttagttttggtattgttgttgtttttgtgtttagtggagatttattggttttaggttttaaaattttagtgaggtttgtagatagggaggagttttatttgagggtagagtgattgttgggtttatttgtttgttatgaattatgtggttttagatttgttatttttttttttttagagttatggttttttgtttgaaaaatggataatgatggttattatgttagggattattttgaggataaatggggatgaaattgaagaggtttagtatggaatttggatatagaagtgttaattgtgtgttattagttgtggtggttgttaaggtttaattatatggtagttatgggttgagtggtgggtgggaagtggggagtaggagtatgtaagatgggtatttttgaagtttttgatttagtgagataagtatatatttagttttaagatggagtgttttaggaaggtggagattgtaaaggttttgtggtgtaggagtgtgagttgtatttttgggttttttagaattttattagagtttagggaggaggttagtttagatataggggtaatgggagagatgggagtgagaaaatggtttggtgtttggaagtggagtttggaaaggtgggtgtggggatagaggagggttttgggggttatgggtttatgtgtttaggaggtggaggtagtgaatggggttatggttggttttatatgtggtattattagttttgttgagtttgtatttgttttttaggttttttgagtgttattattatttggtattttttggtttgatttttgttttttgtttgtttgggaagagtgagattatttgtttaaagttttttagttgtttttaattattttggttgttttttggttttgtttagggttagttgttgatttgaattgtttggtgttatttttttagatttttggggttttgttttggtattaatagttatttttatttttattatttatttgtatatttatttagtagtgttttttgggtatttatttagtaatattaaggtgttgagatgtggttgtggttaagatttgggtttggtttgtgaggattttgtagttgttatttttttagagtatagttttagttaggtatattgtggggtttagaaagagaaattaatatattgtgtttgtttattttgagttgttataaggaatagttgaggttggggggttatttgatttatggttttgtaggttgtataagtggtgttagtatttgtttggtttttggggaggttttaggaagtttttttttatggtagaaggtgaagggggagttggtatgttatatggtgagagagagaatttttagattttttttttttttgaaatggagttttgttgtgttagttaggttggagtgtagtggtataatttttggtttattgtaattttagttttttgagtagttgggattataggtgtatgttattgtgtttggttaatttttttgtatttttattagagatggggttttattatgttggttgggttggttttaaatttttaattttgtgatttatttattttggttttttaaagtgttgggattataggtgtgagttattttatttagtttttttagattttatagtaattagattttttggattttgtgattgtggggagggtattaaattatttatgagggatttatttttatgatttaagttttattttttttaggttttatttttaatattagggattatattttagtatgagatttggaggggataatgtttaaattatattatatgtgatttttttgtgtgtgtgttagtttttatatttggttaagtagtagaagttttttttttgttttttgttgagagagtggtgggggagaaatgatttagggatgggaggttggttttttgaggggttttggtgtttgtggagtgggagtgtgggaaggtttttatgttgtgtgtgttgtgttgggttggttttttatagtttattgtggtgttttttgaggattgttggggaggaaagagttaattaatttggggatttagttgttgaagttattattaaatttgagtagtttaggggtttttttttttttgggttttatgttatttagtatagtggggtttaattgaatttttttttattttttaaggtttttggttggtgtggttggggtttgggatatggggagtgagagggtttgggttttttttagatttggagtgggtttattagaaatggtttaggaaattgtgggggttatttttagtagttgggggtttttgtggttatttttttttggttttgttgagtagttttggtttttggagtttttagtaagggatgtgggggtttgttaggttagggtttttattgttgttgttatgtatagttgtattttgtatttggggagtggggtgttgagtggggtgtttgggaggtaggtttttttttgttttttttgtttagagattttggggatgagttgagtgagatttttttggtttttgattggttgtgtttttgttgttattttttattttttttaagtggaggtttatgatttttttttttatttaaaagggttatttagtgatttagtagattttagtttgtgttatttagggtttttttaaaaatttgtggggaggttgggtttggtggtttatatttttaattttagtattttgggaggttgaggtgggtggattatttgaagttaggagtttgagattagtttggttaatatggagaaattttatttttagtaaaaatataaaaaattggttgggtgtggtggtatgtgtttgtaattttagttatttgggaggttgaggtaggagaattatttaaatttaggaggtggaggttgtagtgagttgagattatattattgtattttagtttggatgatagagtgagattttgttttaaaaaaataaaaataaataaataaaaataaaaatttatggggggatttttgtgtttattggttggtgtgaggagagggtgaggagttgtagagaaggtattaggttgaggattgtttttatttttgggttatagaattgaaggaggggatatatgaaagatgtttttagatttgggttggaggttggggatatttgagggtaaggatgatgttgtttttgtttttgtttgtagaggagtgtatagggtttattagttttttgttgttgtttaagtgatagttttatggagatagaatttatatattgtgatgttgatttttttaaaatttatagtttaatggttttgttgtatttataaagtgattgtattagggttatttagagaaatagaattaatagaaggtgtgtatgtgtgtttagataaagagatttattattatgaggagttggtttattttattatagaggttggtaagtgttaagattggtagagtaaattagtaggttggagatatgggagagtttatgttgtggttttggtgtttatttgaaggtttaagatttaggagagttaatggtgttgttttagttttgagatttaggaaaagtgtatgtgttagtttgagtttgaagtaggaaaaatttgatgttttaggttgaaggtggttaagtgggaagaatttttttttatttaggttttgtgtttttttatttagatttttaggtttttgttataaaattataaagatttgattagaataaaatttgagaaaaaattttttttttttattggttttggatttattggttgggattttggaaattagattgatagagattaataggaaataagtataataatttaagtaagttttatttgatattgagtttttataaggaaatgaagatttagagaaattgttagtttgagtggtttttgttttgttttgagataaagttttattttgttgtatgtttaggttggagagtagtggtttgattatggtttattgtagttttgattttttgggtttaagttggggtttagttgttggttttgggagttgttttgaatttatttttaagttttagtttagatttttaagtagttgggattataggtatgtgttattttgtttggttaattttttattttttgtagagatagggttttattatgttgtttgggttggttttaaatttttgggtttgagtaatttttttgttttggttttttaaagtgttggggttataggtgtgagttattgtgtttggtttaggtttgaatagtttttatttgttttgtttgttttttaaatttgtttgttgtttgttttgagtagtttttttgtttattttttttgtttgttttttgtttaggttggagtgtagtggtatgatttttgtttattgtaatttttgttttttgggtttaagttatttttatgttttagttttttaagtagttgtgattataggtgtgtgttattatatttggttgatttttgtatttttagtagggatggggttttattatgttggttaggttgttttttaatttttgattttaagtgatttggttattttggttttttaaagtgttgggattgtaggtgtgagttgttgtgtttagtttaggtttgagtgtttttatgttgggtttgatgaagagtggaaagttgtgggaaattgtgatagagtaataaaagatgagttgaatagtgagtttgtgggggttttggtaagatttgtgtattggggttttttttagattttttgtttttggagatgaggttgtttttttttgttgggtgtagggagggtattttttatgtgaggggtttatgatttattttagagaaggggtaggttagtgagttttttttggatttgttattttttaaatttttttagttgaaaatatttattatgttaaggtattgtattttggagtgtgtgttttaagttttgttgtttttaattgattgggtgaggtttatttttattagagtatatagtttgttttatttaggtttttgattgtattttttttttgtttgttttgagaatatttattagtagtgtttgtggttgtagtgtttattttaagataaatttgttgggaagtattttgtttttattattatttttatattattttagtatattgattttggaaataaaagatattattttgtttatagtattttatttttagtagtggtattttttttaaaaaaaaatggtaatttttagttgggtgtggtggtttatgtttgtaattttagtatttgggaaagttgaggtaggttgattatttgaggttaggagttggagattagtttggttaatatggtgaaattttatttttattaaaaatataaaaattagttaggtgtggtggtaggtatttgtaattttagttatttgggaggttgaggttggagaattgtttgaatttgggaggtagaggttgtagtgagttgagattgtgttattgtattttagtttggatgatagagtaagattttattttaaaaaataaataaataaataaaatttaaaaaaaaatagtaatttttgattgttgaaaatgttaaattttagagaatatagtatttttataagtgatgttaatattgtttttgattagttgttggttgaagatttatttgatgaatttgatttttttagaatagatgatttagatgattttgttgttttgtttagaaataattgtaggaataatttaaaaaattttttttttttttaatttttttgttttttgagatggattttttttgttgtttaggttggagtgtagtggtatgattttggtttattgtaatttttgttttttgggtttaagtgattttttagttttagttttttgagtttagttgggattataaggtgtttgttattatatgtggttaattttttgtatttttagtagagatggtgttttattaggttgattaggttagttttgaatttttgattttaaataattggtttatgttggttttttaaagtgttgggattataggtgtgagttattatgtttggttagtttttatatttaatttttatatagagtatttagttagatttgttttagttttaaagagtgtgtttatgtaaaattaagtgagtgttggtagtgagttgaattttttaaaaggtaaaagggttaaatattaaatttatttaaaaatatttttatagatatatttagaataatgtttgattggttatttaggtgttttatagtttagtttagttgatatagaaatttttttttttttttttgagatggagttttgttttgttgtttaggttggagtgtagtggtgtgattttggtttattgtaagttttgttttttaggtttatgttatttttttgttttagttttttgagtagttgggattataggtgtttattattatatttggttaatttttttttttgtatttttagtagagatggggttttattgtggttttaattttttgattttgtgatttatttgttttagttttttaaagtgttgggattataggtatgagttattgtgtttggttgatataggaaattaattattatagttatatagttattgttattaattttagtatattttattatttttaaaagagattttgtttttattagttaatttttatttttaattttgggtttttagtttttagttattgtttatttgtttttgtttttatgaatttatttgttttagatagtttgtataagtggaattgtatagtatgtggttttggtgtttggttttttttatttggtagaatatttttaaggtttatttatattgtagtaggtgttggtgttttatttttttttatggttgaataatattttattgtggatagattatattgtgtatttttttatttgttgatggatatttgggttgtttttgttttttggtataattttgttgtgaagaattttgtagtgagtgttggtttataggtttttgtgtgaatatgtttttattttttttgggtaattgtaagattatgtggtttagttaattagtttttaagttatgtgtttgttgagggatttaggtttggtgggggtgtattgttgtgtttggttagttaggtgttgtgagtttgtgttgtagttatttttttgtgttgtgttttgaggttgttttgttggtattgggtattgtgagttttaggaggttaaagttttttttgttttattttgagtttaggttttgttttatgaattaggatgaatggatattgaattaatgtagggatgggtggggttggggtggggatgtagagtgattttgggggtttgtagttgggttttggttgttgatttttagttttttttgtttgttggagtttagaataagttagaaaggggaaatgtaaagtttgagtgttttttttgtggtagattggtaggtttgggtgggtgagttatttgtagttagttgtagtgtgagagaggaagtgggaggggagggagagggtgagtttggtgtaatttatttttggaaggaggttgggttgaggttgggggaagtgatttttatttttttgagaggatttttttttggggttaattttaaattaagggagataagatttttttgggggaggttggaagtgttggggtttttaggtgggtaggttttttagggttaatgttttggggaagttataagttattatgtttttggattgttatatatatatatatatatatatatatatatatatatatatatatatatatatgagtaaattgtaatataaatgtgtgtttatgaaagtgtttattttaaattattatatagtttgtaaagtgaaggttttggtttgtatttgggtatttattgtttagttagttggtaggtagtttgtattgtagtttgttattattttttagagatgtagttgaggagtttagttggtttggagggtttagtgggtgtagttttaggaaagtggttaggtttgggttaggtttttttttttttttagttttgggagaaattattatatgaatgtagtttttttttggagtttgggttggaagggtttgggaggggataggtttttattttaggagtttttaggttttggttgttgtttgtgttagttgtgtgagtgtgagtgagttaggggttattattgggtggaaggaagaagtgggtattttttttaggaggttattgttggagttttatagtaggttaattttaggttttgggtttttgggaggaggagaaagaagagaagtaggaggtgtggagggtaggttaggattagaaggtatatagggttggggtagtgtgggagattttgggggtttttttatttaattagttaatattatagtgtttataagaatatgttattattgtagttttattattttgttttgattttagaaggtataattgatgattttagggaatggagaatttgaggaaggttttgtaggagagggttagatgtgattgagtaaatgtgagttgtttgtaaattgtagagtgtatgtatagtattggttagttttggggttagtgtttttttggtgtttagtttggtttttgtattttttagtgtttggttgggttttgtgggggttagggttgggtttggtatattagaggatttttattaagtttttggtagtgttttagttattaaatttagtttgttagttattaaatttgttttgttggtttttgaattatttttttgttggggttggttatgttatgttaggttttttatgtaggatggtagatggatagatgttgggattaagttatttttgggttgtgagatgtttgattttttgttggtgttttagaagatgttagttttttgtggtatgttttttatgtggtgtttggggattagtggtttttaaggggtttttttgttttagtgtggggagtggtttggttaaggttttagtgtttggttggagttaggtataggtttaggtgtattggttggaggttttttgtttatgggttttgtttgttttgtgtttttggtttttattgtgttttttgtgtttttgggagagattttaggggttttgagtttagtattggggttggggagtgggtggggaagagggtggggattagggtttttggttgtagaatagttaggttttaagtttttattttattttttttttattgggtgttttattttatattgattattttttgaagaaaattttttgaattggttttttattttggttgttttaggaagtttatttatttttttgttttaatgttttgtggttttagaaggatggtggaagttggaaattatgagttttatttataggtggttatatattgaagttgtggagatgttgtgggaaaggattttggttagtgtggttggtatagagggagtggtgttattggggtagatgggaattgtggttgtttttatgttggtttgggagagatgaggggttggatgaaaggatagtagattggttatttatttatttatttatttatttatttatagtgttttattgggtgttttggatgtgtaaggttttgtgggtagtgaatgtgatagattttagatagtaattggagggttatgtgtgtaagaattgagggatttaggttgggtgtggtgttttaagtttgtaattttagtattttgggaggtagaggtgggtggattatgaggttaggagattgagattattttggttaatatggtgaaattttgtttttattaaaaatataaaaaattagttgggtgtggtggtgggtgtttgtaattttagttatttaggaggttgaggtaggagaatggtgtgaatttgggaggtagagtttgtagtgagtttagatagtgttattgtattttagtttgggtgatagagtgagattttattttaaaaaaaataaaataaaataaaataaaataaaaattgaggaatttagtgtagatgagttattttgggaaaataagtgggagttttaggaatagtatggggaagggatggttttggtagggaggatttttgtgggtagttttgttggaagagttgaaaggtagttagagaggttgtgtgtggatggaagttgaagagtaggttaggggtgtgtgttttgttaataaagattttaagtatttattgattaggtataatattatgtgttttataaataaatattttatttgatttttagtatttttatgagatagatgttattattttattttatatgtaagaatattgaggtatagagtggttaagttatttgtttagggttatatagtatgttggtggtaggtaggattttggagttataggaatttggtatattttaggtgtaatggaaattagttatggttttatagagggaaattattagattagtaaattttatatatgttttttggtgttttgaggaggagggatttggataggggtagttaatggtggtggttgtgagatgtgttgggttaatattgatgagagtttgggatggatgagtggatttggagtaatggaaatggagggtttaggtttggtttttggagatttagttgtaatagttgttggttggagaggttgtttatttagatgggggatggggtgggaggtaggtgagatgagagttttagagtttagtttggggtatggttattgggtttaagatgtttttagatgttggggtttgatagtgatagtggttgtagatatttaggatttagtagagggtttggtatagtggggtttagggatatgtttgtgagttaggttggtatttaagtgtgaatttggataaagaaggtggtattgttggtattgaatgtttaggggttgggtgaagttagttagggagaggggtttttaaggtattaggattgattttgtgggtgagggtggaggaggagatggtagaggttgagagaatagttagagataggaggaaggttagtagagttatgtatagaagtttggagaagatttgaggaaaggaagggttgggtggttgttattttttgtagttaggaggtaagggtgatttttgtgtgttttattttttagaggattggtggttttatttggttagaattttaagtttagagatgtatttgagttttatgttatggtgtaggtagtaggagttatggagtaggtttgtggggttatggtttgtttgttgttttttggtgtttttattttgagtttaggggttgtttggatgttttgtgttgtatttttttaggtggtgttttagagaggatgaaagtggttattttaaggtgtgattaggtagtggtttatgtatattgtttttttttggggagagtttgggatggaagggtatgtgtgtgtttttgagattttttgaataggttttatgtatttatttatttattttattatttatttatttatttatttatttatttatttatgtatttatttatttatttatttatttatttatttgttaatttatttatttatttatttatttatttatttatttatttatttatagttatttatttatttatttatttatttatttatttatttatttatttatttatttatttgtttatttatttatttatttatttatttatttatttatttatttatttatttatgtatttatttatttatttatttatttatttatttatttatttatttatttatttatttatttatttatttatttatttatttatttatttatttatttatttatttatttatttatttatttgtttatttatttatttatttatttatttatttatttatttatttatttatttaattatttatttatttatttatttatttattatttgtttatttatttatttatttatttatgtatttatttatttatttatttatttatttatttgtttatttatttatttatttatttatttatttatttatttatttatttatttatttatttatttttttatttatttatttatttatttatttatttatttatttatttatttatttatttgtttatttatttatttatgtatttatttatttatttatttatttatttatttatttatttatttatttgtttatttatttatttatttatttatttatttatttatttatttatttatttatttatttatttatttatttatttatttatttattaatttatttatttatttatttatttatttatttatttatttagttatttatttatttgtttatttatttgttaatttatttatttatttgtttgtttatttatttatttatttatttatttatttgtttatttatttatttatttatttatttatttatatatttatatatttatttatttatttaattatttatttttatttttattttagaaagtatttgaagttgttggggtgtgtatttggaaaatgtgttataagtttttataggtttttttttggtttttttatttttttgattggttttttttttggatatgtaggattttgagtagtttttttgggaggtgggtgtagtttaggtaggttgtttgtaaagttaggattgagggagttatatttaaggtattgtgggtttttaaggtgatggtattgtgggtttattgtttttagatttttttaatttttaggtttttgagtaggaggatttttggggtagggtttggagatgggaagagaaaataattttagttttttaatttttgttagtttaggtgggtgttgtatggattgggggtatttggaatagttggtttttttattttttttttttatttttttagtttttttggttataattagatagttgtgtgtgatgttttttttttttttgaaggggttatttagttaggtttttatttatggtttaggaatgtgtttttttttgtttgttttttatttttaagtaggttgtgtttttagttttttgttgtttttgaagggtttgggtatggggtagtttttgtagtatttttagggtttgagttgatttgtatagtagaagggaattgggggaaagttttttttttatttagtatttggtagggggttattttgttgtattttagagatttttgtttaagttttgttattttagatgattttataagttgggggaggtggagttttagtttttatagtttttgttgttgttttattgttgagttttgttgtgtatttgttgataggtttgttgatagtagaaggggttggagagagggaagttttgggttttgttttttttaatttttgtttaggggatatttttgataagaggaaattttagtttgtgatagatggttagtgtttatttatttatgggggaatttttttttttttttgtaagtttgtagatttgttaggaattaaaggaatttttggttgataggttattgtggatatggttggagggttggtatgggttggattttggggttgttttgaggtaggggttgtttttgttggaaggttttttggggtggggaaggtattagggttattttttgattttttttttgtagtggatttattttagagtttgagataaggtaagggggtagtagaaaatagaatataaaatagttttttttattatatattgtattagaagttagaggatttatttttggtttgttttttttgtagtttaagttttgagagtggttttttaggaagtgaatggtgatggtttgtaggttagagtttgttttggtttaagattgatgttttaataggttgtggagtttgggtgaaaaaatttaggttagggaggtggtgggttgtaaatgaaagaatagaggagggttttttttagaaagtggtgggtggtgtgaggagtttttggattttgtttaaatttgattttattgattggggttaattgaaattgtgttggtagaaaggtaaaattgtttgagatttttttttttataatagaggagaggtttgtttgaaagggtttggtgagggaaaagttggaggaattttggttggtagtaaaagtggggatttttgttttttgttttgggggtgttttggtttttgaatgaatgaaagaggaggttggatggagatagatttatattatttgttttttttaggttttgtaaaggagtatatagggtttttgttggtttttttattttgttagttattaagaaggagaaaatattaataggggaattgtaaagttgtagttttgtttaagttttatagtggaaattggaaagagttttagtttggagaaaaatgtagttttttgtttttgtaaatttgtgtttttttttgggaggttagagttattgtgtttgatttttaagtagggttttagagtgttttaggaggggaaggtagagttttagatttttggtattttaggttttaattaggttttgaggagatgttttttgttttatataaagtgtgaagtgtaatttgatttggagttagttaataaattagatgagttgtgtgtattttaaaaatttagtttttgattttttatttatatatatttgtataatttggttatttatatttagtgtttttatttttagaagagaataggaagtttttagtgatatttatggagtgtttgtagtagtttgggtaggttagtaggaatataatgtagtgaaaagtagagttgagatgggaaaatattttgtttttagagttttttagggatgatattttttattgtttttgtttatttgttttggagtttattttgtaaatagtaatttgtttttatttgagagtttttttttgttggagtttagggatggagagtagttggttttagttttttttttttatttttttgttttttagatttattttttattttgaataattgtttttaatttgtttttttttttttttagttgtagaatttagaattttgtgtgtgtggttaaaagtttagagagtgttgtaggtaatgttgagataattttattaaattttgtaagtttttattatattaagtttgtttgttttttttaatttttattttattttattttattttatagggatggggttttgttatgttgtttaggttggttttgaatttttgggtttaaatgatttttttgttttggttttttagagtgttaagttatttttttaattgggatttatgggtttagggattttttgatgaattgtttaaaatatgtgtgtgtttgtttgtttgtttttaatgtatatttttttagggagagtttttattttttattagaggtttgtggtatatatatgttttgtattattgtattagattgtgaattttttatatgttaaagattgttttaaatttgtttggaagttttggttaataaatatttaaataaatgaattttaaatttttatgtgttattattgtttttattttgattatttttaagtttgtagtgttatttttttgttattgtgaagtagatatttaataaatatttgttaaatgaattaatgttatggttttggtttattaggattttaggattattgtttattattattgtttatagtttttttattattttgttttagagtagttttttttttgaggtttgtttatttttgtatgtgtgtttagtttttagttttgttgttttattatttttttttttttatttgtattttttgaattgttaatagttaataatagtttttttttttatttatttatttatatttgaagtgagaagttattattgaggtttttgtggattttgttagtttaatttggggtggttttttggaggtggagtttttagatgagggatggatattttggtgtttgttgggtagatttatttgggagttttggtaggggttttagggtagttttgtttttttattttggttgtgggatttttggtgtattagggttttttaagtaagtatttgtgttttgggagagttataggtaggtttgagagggtttttggaatttgggatttttagtttggtttagtagttggtattattattttttttgtaagggaagttatggaaattaagatgttaatgtgttttgataggtttggggtggttttaagttttgggaagagttttggtaattttttttggttggtgggtagaatttttttttggtagtttagggttttgtttttagttttttgggggagagtaattgagggaggagttggaggttaaggttttagtgttgagttgtttgtattgtagttgtattttttgggttttggttgtaggaattttatatttttttagtttttttatggtttttgaagatttggtttggggagggggttagtagtttggggtttatttatttggttttaaattttggttttattgtttatttgttttgtgatttttataattgataaaagtttttttggttttggtttttttatttgtgaaatgggataataatagtggttattttataggattgtgtgatgatttattagttataatagtttttgagtagtgtttagagtaatatttggggtttggtgtagtggtttatgtttataattttagtattttgggaggttaaggtgggaggattgtttgaggttaggagtttgaaattagtttgattaatattagtgagatttattttttaaaaaaaaaaattagagtaatgtttggtatagagagtttttagtaaattttggttgttgtgatgagttttgtttttttatttgtttatttatttattagattttttgttggggtttgttgtgagttttatgttgttttgaagaaagttgggttggggtgagtgtgatggatgaggtgtttggttttataaattttgtgtgggggggttgtggtgagaggaaattgtatatattattatttagttattattgtggggagattgtttggatgtagagagtaggttttgtgtgggagtggggagggtaagttttggttgtgaggtagggtttttttaggatttagtagggatttgaaggattttgtaggtatttagggagataggagaggaggagggagtagttttggttggatattgtttttttagtattgtttgtattagggatttatttagttttaagaagtttttttgtgggggatagggagtatttgttagtttataggatttgaagtgtttttatgggtttaagtttttgggaaggtttgtaggtggttgtagggttgttgtaggggtgttggttttagggtttggatttaggggagtttgtagagggagggtagttggaggttgttttagtgtgtattgttatgaggtaaagtaaggagattgttgggtttatgttgggttggggtggatggaggtaaggaagtttttgttggggtaagggtattagttgtagatgttggtagtttttttttggatatgggtttggaaggttgatagggtgtggtgagtgttattggtttttttgttgtggtttggttagtggttttataggtttttgtgggtaggaggaggatgattttgtattttgtttggttattattggtagtgatagataaggtgtgtggggatgtggttattttggtttgtgttttgagagttaggtgtgggttgggtttggggaagataggggaatggtattgatttgattttgagtattttgttttggggtgtaggtttggttgttatttttttggagttgggaatggtattgggtggtggtttagggttttttgttttagtggtattatttttgtatttggttagtaaggttgatgggatttgtgtggatatttttgggatgtagattaggtagtatgatatatagggaggggtaggtagagaagggtggtttttgggttttggtttttaagttaggttttgtaagtttgttgtgttaagtttttttttggtattaggttaggtgggttagggttagttttggggttgtgatgagtgtgagtgtttttaaagtgtgttatgtttaatagttgttttttttttgggtattgttttttagttagatattttatagtttttgttttagttatagatagtaatttgatttttttatttttggtaggttttggggttggggtaagaatttgttattaagtgtagatgtttttagagggtgttggtttagggttgtgtggattatagtttttttatttttgttttagatttatttgtaattttggagaaaagatggtttagtggatgtttgtggggaggagggagttggtttttaggatgagtagatttgggggtagtttttattatgggattggtgatttattgttattagtgttagtgaatggtagaggggttttggtataaggtttgggtttagaatgggaatttgtagagaaattgttaaggttttttgttatttgatatttttgtttggttgttattttagaaatatttttgttgtaagaagatgggggagtttgtttggggtatggtttggtgatattaatttgagaattttaggtttaagtgttggtttttgggttttagttgttttttgagttgtaaagttggtttttgggtatttgtggaaaatattggattttttattttattttattttatattttgggatatatgtgtagaatgtgtaggtttgttatataggaatataagtgttatagtggtttgttgtatttattggattttttaatttagttttattagaaatgattgttttttttttttttttttgttttttttttttttttttttttttttttttttttttttgtttttttttttttttttttttttttttttttttttttttttttgtttttatggggatataatttttatattatattatttgttgatttagaaagtatagttgagtggtatttttttataattttttataagtattatttttaattttagaatgttttttttattttaaaaggaaatgttatttttggtatatagttatttttttttttttagtttttggaaattattaatttgtgttttgtttttatagatgtatttattttgaatatatgattagaattttaaaagatgtgattttttgtgtttggttttttgtagttggaatgtttttagagtttatttgtgttggtgtatgtttgtgtttttttatggttgagaaatagtttgttgtgttgatttagtatgttgggtttttttatgtatttgttggtggatgtgttagttatttttggagttgggtgtgttgtgttatttatgggttgtattaggagttggggatattattgagtaagttatagttttgggtatttaggagtttgtagagtaggagttgggagggaggttaggaggtgtatggtttgtttgttaggttggagagatttgtaaaaagttattttgagttagaaattagagtttgaggtttttgatttttagttgtggagttgggagggaagttttgtattttgttttgattgtggggtgatgtgttagttattgtttaaattagaatttttttgagagttgatgtgggtattgttgataattagtttggatatttgaaagaatggaaagtagggatttagatagatttttgtataattgtgtttgtagtagggtgaggtttggaggtgtgatggggattttaatggggtagttgttgttttgttggagtttatggtttttggggggggttataggtgttaattgtatattatataagtaggagtgtgaaattttagggttgttaaatttagtgagggttttgtgttggtttggttatttatagtggtattttaggaaaaaaaattattttatggattttagtttttttattagtaaagagtaggttggattggaattttgtattatttagtatagttgttatttatgaaatgtggttatttaaatttaaataaaaatagaaattttgttttttagttggattagtttagtgttaagtgtttagaagttatttgtgaatatattgtggtaattttttaaaaaatgaaaattagaattattgtagtattttataattttatttttgggtgtggatttaaaagaatgtatagtattttaaagagttagagatatttgtatatttatatttatagtggttttgtttatagtagttagtgggtagaaataatttgaatgtttgtggttaaatgaatggagaaattaaaggtgggataggttgggtgtggtggtttatgtttgtaattttagtattttgggaggttgaggtgggtggattatttgaggttataagtttaagattagtttgattagtatggagaaattttgtttttattaaaataaaattagttgggtatggtggtgggtgtttgtaattttagttatttgagaggttgaggtaggagaattgtttgaatttggggaggtagaggttttggtgagttgagattgtgttattgtattttagtttgggtaataagagtaaaattttgtttaaaaaaaaaaaaaaaaagggtggaatatataaggaatttgatttagttgtaaagaggaagttaggatatttgtaatagtaagggtgaattttttgggtattatgttaagtgaaataatttggttataaaaggataattttgtaggattttatttatattaggtttgtagagtagttagatttagaaaaatagtagaatggaggttgttagaggtttgggggatggggttggggagttgtttaatgaggatagtttgttttataagatgaaaaagttttggagatttgttatataataatgtgaatgtatttaatattattggattgtatattttaaaatagtgattgtggtaaatgttatgataattaaaaggaaaagttatgtggttagtggttattatgttgagtagtgtaggttttggatggtgttgtggttatagataatggagtgggtgatttttattattgtttttagttgtttgagtattatggtgttttggggttaggatgaaagtgtttttgggtatgggggtttttgttttttttatttgggagttttgaaggtagattttaaagtttatttggttaggtaggagagtgaggtgggtttttgtattgttttttgtgtgtgtgtttgtttgtgggttagttggggtttgtaaggttgttttttgagggaggggttgtaggaatggtttttatttgtgtagaaggtaagttattgttttatgttaatggtaaagatggggtttggttgtgttgtattattattttttaagtggggtttttggtgggtaggatgtttggtttgatttgagtttttgtagtgagtgttggtgtttgtggagggatttagttgtagttgagttggttttttttttgttttgggttttaggggtgttgggggtgagaaaggagagtttagggggtagtgtttttttttaggttttgttggggagggttgagggatgttggggggaggtgggggtgggtaggggttggttttagttttaggtaaaatggtttttagatttataggtagatggaagtgatttttggttatgtgggtggggattgaattgttgttttgtaaggtaaggttttatgtttggttttaggaagtggttttaaagttatatggtttatggttagatgtagggttgtgtttttgtttatttaaaggttttggaagtttaggggagagtatttttgaagggggagtaggagtaggagtaaagttttgaaggtttttaggttgtgtggtttgggtgggggttatgtgggggtatagagagaggagttttggtttttaggtttgtttgtgggtattgtttttagtagtggagatgtgtggatttttttttggtattttttaataaggaattatattgtttttttgtttttttaattttataagataggaatttttgtgttttgtggaggttgagaagatggggaggtgtttgtgaggataaattagtttttagtttttggtttttagagttttttttttttttatttttgatgttttaggtttggggagtttttttttgatattttttgattgttttagtgaaataggttgagagggatggtttgaattggttggggatgtaggttgtagttagggggtttagtgggtattttttgagtttggtttttgttttgtaagtggaagggtagttgaattgaagttttttattgttttttttggtttggaagtttgttttttattttttgggtagagtgaggagtgggtgtgggttgggagggttgttttttgtttgggagggttgtttatttgtttgttatgggggatgagttttttgtagttttttgtgttgtggttttggtttttatgttggttttatttttttgtggttgtttttgttgggtgtttattggttttagggaaaagttattttttttttggaggattggtgggaggggttttgtttgggagtgtgttgtgtggtttttgttttagtgtaggatgtttgaggttagattttttttgggaggtaggatggggtaaaagtttttttgtaggtagagtagggtttggatgggtttaagtagggatgggggtatagaatagtagttgtttagtttgtgtgggagttgagggttattaagggtagttttagtttgtggggattagtagaggtattatttttgtgattagtgagttgtttgtatttgtatgtgtatgtattagtgagtgtggtgagtttgaggtgtgttgggatttggtttgtgtattagttagttttgatgggaattagttttattttgggtatttttggaattttattgtgtgggagtatttgggtttttagtaggtgttttttgggtgtttgtttttagttttaggtttttgatttgtgtgtggtgttttaatagtagttaggagtagggttattgaagggatttatagatagaagaggttttagtgattttgggaagtttagttttatgtgttttatatatttaagagtaaaatttggttttggtttgtgggtgtgtagtttgtgggtgttggttaggtatataagatggttgtttgggttagtttagggggaggtagatgtggtgtaggggttttttttttttatgagtttaggaatagttttgtatttaggtatttgttttgtatttagtattttttttttttttaggattgttggtttgttttatgggattgaatatataattttatggggattgatgttggttttattttttttttttataagattatttatggggatgtgggaggtggggatatatgttggttttatttttgttttttataagattattttttttgtgttttggtttgtggattggtttttaaggtttttgagtggtagtaggtggtatagtttatttgagtagaggtgaaggagagggttaggtttatttgggtggtttgaggtagtgtggagggttaggagaggagagtattttttatttttgtttgagtagttttttagggtatggagataggagtttagggttagttttgttttggagtgtagggggtttttagtttggtatagtttttagaagaggagatgaaaaagtttggttttgggagtttggggatggagttttgttggggaggtagtgtggttgtaggatggtagttttttagaggatattatggttagggatatttatttgggggaatttttaggggttgtttgggtaagttgtttagtttttttgagttttagtgttttagtttttttatttaaggatgggtgtgataattatttggtaggtgtttgtgtgtgagtttttgttttgttttaatttttttgttgttttttttttagttattgaggtggtttttagttgtgttggtgatatggttgatatttttagagatgttgggtttaagtaggtgtttgtattatggaatgagaaggttttggtggattttggttatgtggggattgattttattttggagtagatgtgttggaaggttatgaagtagggttttgagtttaatattatggtggttggtgagtttttattttgtatgttatttaattaatgttggaaattagttttagtttttagggtggtttataagtttttgggtttggtttttttttttgtaaaatggggtagtaattttgattttaaggatggattgttagtgatattgtgtgtgtatgtatgtgtttgggaggagtttatagtttttagtggttttttagaggggtttgttttgtatatttagggtttttgagatgattttggggagtttaggttggtttggagtaggttttgatgagtggttgttgtttttgagtaatgatgttagtttgtgtagagggttttgtggtagttgtttttttattgttgttttagtttggttttttaggttttttattgtattttattgtattttggttagaggttttttagtagtttagttttagttttgttttggaattggggttttgtggtttttatattttttggtggttttggagagttggaggttattatgggaggttgttgattagtatgatttgggtagggtgagggggttaggttggagtttatagtgggttgtttgttgtttttaaagttttttaggttttatttaaattttatagggattttgtgaagggggtgttttgttttttaggtagaagtgaggtttagggaaggttgttaaggttttttagtttatagggtagagaattgtagttattgttttgatttttagaattgtgttttgtttattttatggggtttagggaggggtttggggaagtgtttttgttaggttatattttaaataaaggtgagtttgtggggtttttgtaaggtgtttgggtattttttaggttgggtttgtttttttgatttttgttagttgtgtatgttttttttgtttagttttgtggatgtaaatttatatttgttagtttgatatttttttttttttttttgtattgatttgggttttggtttttttggggttttggtgttttttttgttttttgtagttttatgggatttggttgtttatggttttgttgtgtttatagttgtttggaagttggtagtttgttttaagggagggtggaggtgtggggtttttttttatggtttttattttgttttgtttgttgtgggggatgtgtttgtattttgaggatttagggttgttttttgggaagatggttggagagaaagagaggggagaggtttaaaggtagtggttaggttgggatttatttttgtgggttatggaggggttgttttgttttttagttagggatagggtgagaaggatttgggaatttttgtgttttagttatggtataggtttttttttggagttttggttttaaggagagggagaggtagtttagtagtttttgttttttgtggttgttattgtgatagttttgttttttgggaatggtgtgtaggaggttattttatttgtttgggtttttttgtttttttaattttgagaagaatagtggttttgattttttataaaattatttttttttagggatgttgagtgaggaataagatgtggggtagttttgtttttttttttttttttttttatggtagttgtgtttatttgtagaggtgtaggtaaggtggaggggtatttgtttggaggtttatagattttggggagaattttagttttgttttaatttagtggggtgaggtttgtgtgtttttttttgggttttttttttgtgagttttagtttttttgtttataaaatgggattattttataaagtgagattaagtgagttaggttttgggtagggtttttaataggttgtggttgtttgagaatttgtagtagtggtgatggtggttgtggtgatgaggatgatgggggtggtaatgatggtgatgatgatggggtgatggtgttagtggagatgatggggatgatggtgatggtggtggtgatagtggtgggatggtagtggtgatgtgggtgatggtgattgtgatggtggtggtggtggtgatggaggtgatggtgatagtgattatgagggtgatggggatggtggtggtggtgatggtgatagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggtgatggtggttgtgatggtggtgatgtgggtggtggtgattgtgatggttgtgattgtgatggtggtggtggtgatggtgatgatggtggtgattgtgatggtggtgatgggagtgatgttggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgttggtgttgatgattgtgatgatagtggtggtggtgatgagggtgatggaagtggtgatgatggtgggagtgatgggatgatggtaatagtagtgatggtattgtgatgatggtgttgatggggatggtggtgatgataagggtgatgatgatggtgatgataataataaaagtaataataataaagggatatattttgtagtattttagttggtattttttagatttaaggtgttgtggttggaatattgatataatttttgatttgaggttggttaggatatagatttggtggatagagagagatggatgaggagtgtttgtttttgggttattaaatagtttaggttagggatttttagtattagtttttgtttttttaggagtttatattttttttagaaaggtgttattaaagttagaatattagtgtaatttagggtgttttttgtgttgtgtttttttgagatagggttttattgttgtttaggttggagtgtagtggtatggttttgatttattgtagtttttatattttgggtttaagtgatttttgtgttttaggtatgtgttattatatttggttaatttttgtgttttttggtagagatagggttttattatgttggttaagttggttttgaatttttgattttaagtaatttattttttttagttttttaaagtgttgggattataggtgtgagttattttgtttggttgatttttgtttttttaaaagatagggtttttgttattttggagtggtaatgattttagtttattgtagttttgtatttttgggtttgagtaatttttttattttagttttttgtgtagttgggattataggtgtttgttattatatttagttaatgtttatattttgatgtagagatagggtttttttgtgttgtttaggttggttttgaatttttgggtttaagtaatttttttgttttagttttttaaagtgttgggattataggtatgagttattatatttggtttagggtattttttttggtgtgttgttagtgtagtttaaggtagttttgtgtagggtaaagtaatggggttttgagtttggaggggtgtgtgtgtgtgtgtgtgtgtgtgtgtgtgtgtgtgtgtatgtgtgtgtgtgttatatgtgatttgtttgtgtgtgttgtgagagttgtgtgtgaggtatgtgtaagaggtatgtttgaggtgagttgtgtgtgtgttgtgagttgtgtatgtgaagtgtgtgtgttgtgaggtgtgtgtatgaggtgtatgtgagttgtgtgtgttgtgttgtatatgaatgttatttttttatttttgtttgttttagttatttgtggattggttgtttgtatatatggttattgttttttgagtggtattattttgtaggttagtgttttttagtatatggttttatagattttatgggatatgtgtgagtttgtttgatgtttatattagttttatgggggaaggattgtttattttattttgtagattaggaaattgagatatggtgaggttaggtgatttgtttaggttttggttggttagggaggagtagtttgaatatttgggttttggttgtaattattttggtgaattgtaggaattttggttatttggtgtattttgggtagttttgggtttttttgttagtttggtttttgttttgtttaaaatttgagttattaggagattttttgtttagaaagtataaggggtataagagatgttgatttttttaggtttggtttattttttaggagaggattgtggtttgggttgtgttggtattagagtttggttgtgtgggtttatatagttattggatatttggtttgagggtgaagtttttgggggttgtttggtagggatattgttgggaggtagtttaggtattgttgaattttagattggagagttttgtgtttgggtgggaggggttttatgtgtagattttgttggtttttttggagagatttttgattggttttttattttttttttagggtagagtggtttgggtaaatttattttaattaatattttttttaaatttaaaattagttggaagttggtgtagtttattttagaggagtgtatttttaagattattgagattaagtttattatgtatggttagtggttgggagtgggttgggggtgtaggatgtttttgtttttttggagtataggggttgggggttaagattattatatatagttagtggttaggggtgggttgggggtgtaggatttttttgtttttttggagtatagagtggggggttaagattattatatatagttagtggttgggagtgggttggggatgtaggatgtttttgtttttttggagtataggggttgggggttaagattattatatatggttagtggttggggatgggttggggatgtgggatatttatgtttttttggagtattggtgtggtgtgagggtgtttgagttaggtaattttaggtttttaagatggggatttgttgtgtttattatttttagtatgttgagtatgttggggttttggttgtgatgggttagtgttttggatttttgtgggttttgttatattgagttttttatagataattgagttttttattaaaagtttgataggtaaggggtttttaggggaattgttattggtttgtgttggagttggttgaggaaggttattaattttttggtgtttttttggttgttattgttgtttatttggggttgttttggggttagttaggtgtggggtgtttgtgagggttttttgttttttttttgattttgtgtttgtggttttgtgtagatattgaggagaaaggtgtttggatgaagttgatagtgattgatatattagggtttggggattatattaataatgagaattggtgaggtttttttagggggaggagtattagtgggggttttagggttttttggattttatttagagttagttttagaggttttttggtttgtgggggtgtagggtttattttttgggatttgatatgttgttaaagttgtatgttttaggggtttgaaaattttggattaaagtagaattatttggggaattttgttgtttttaatttattatttgaggttagtttggggaggttggtttgggaggttgagggtaaggttgtggtatttttgtttagtaagttagattttttagggtatgtattttattggaaggtggggtgttgggttttgagttttgggaatgtatgatttgtttggggagggtattttatgtgtttgttgatttgtttttattttttatgtagttggtagtttattatgaagtttattaatgattagtatgagaaatatttgtaggaggaggttaatattaattgtaagaagtgtattttggatatttgtgtttattgttgtttttattttatttttgttattggttatttgtatgtttttgtagtgttggtgtttttatgttgggtgttttgggttttttttgttttttgggattgtaagatggtgttgtttgttttgttgttgggtgtagaggggttgagttaggggttatggttgttagttatgaagttgggggtgtgttatgtttgtatttttaaagttttatattgatttttatgtaagtgttttgtttagtttttattttttagttgtgttttggggagttgagggttaggtaggttttgggttgttttggagtttggtggtttgtgttttgtttttttaggttaggttttggtaggtggagtgggagtttttagttaagtatttgtagtggtgattgatttttttatttgggttttgttttatgggattttttagagggtttggtgtgtttttagatgggaagtatagagattagtgttggttttttttagggttggatggggttgttgttggtgttggtgagagttttttttttttgttggttttgtttgtatttgatgttgtttttagagattagtaagggtgggaggttgtatgtattttggtaggtggattttttatggttttatggattttttgtttttagttttttgtgtattttttgttagatatttgtggtttattttgagttagggttgggaggaggaggattagaggttagtaggagtggttggtggaggtagttgtgggtggtttgtttgtatgggtgggtggagaaggttttttgtatttgttgttttagatgtatttttttgggtggaggaagtttaggggtttggggaaattatattttgtgggtattaggtgtaggaaggagtttggttggtgggtagtgggttttatttagagtttgtgggaaaatttaagttggagtttttgagtttattttttggtattattttttgtgggttagtaggagttaggggtagggggttagtttgttgtttatgggttttttttgaattgaatatttgtttttttaggtagaatggtttatttgtggttttgtggtagttgttttagttgttttaagttttgttttagttgaggttgatggtaggaggtagaagttttttttgatgttagttgggtaagttgagggtgggtgggtggtttgtggtatttttgttattttttagtattgattttttggttgggattttagttaggtatgttgtttggttttgtttaaggtgtttagttttatggggtaggggtgggttttggttatttttgtttaaatttttgtttggagtgggtttttttttagttatgtgtgtgattgatttatttttattgtgggaaaagtttggttttagaattggggaagatggtgttttagttttagggttttgttagtttttgttatttatagttttttttatattagattttaggtttattggggttaagtaggtaaggggagtagtttgtttggtgtaggggagtagtttgtttggtgtaggggtattgtatattggtgttagtttttattttttttgtttttttttttttagttaaagttttatagtaagatggttgttgagttaatgatagtttttttgtgtggatatgtaggggtgtggttgggattttagaatttatggatgagggtgtttggagttggttttggtttgtttggtttgtgtagtggtgttatttgtgtttgggatatatttgtgttttttttttgttttatatttatagtgtggttgatttggtttggggttttgtttttgttagtagggatttttgtgagttttgagttagtatttgagagtgttgatatttgtttgggggtgggtgtttttttattgttttgtttttttagatgagttttatgtatatttttttgttttagttttaggtttttggatattgagtttatgaaatgtttgagtaaggtggttaatattgtttttgttattgttaaggtggatatatttattttggaggagagggtttattttaaatagtgggtagggttttatttttatttgttttagtttttttgtgtaatttggagatgttgtaggtttggtaggggttattttgtttaaaggagttatattgttagggagattgaattgttggttattttttttagtgggtggttggtttggtggtttttggtttaggtggttgttgggggttgtttttgagatggtttttttagtttttttatattttaaaagtagttttgtgggagtgttaattttttagtagagtttttgaggggggttttggagaagatttggattaggtagatggtgaattttttttttagggagtgaggttgagtaggggttgtgtgatatggtttattttgttttatgttttttttttttttttttgagaaagggtttggtttagttgttaaggttgtaatgtagtggtataattatggtttattgtagtttttattttttaggtttagtttttgagtagttggaattatagatgtatattattatgtttggttaatttttgtatttttagtagagatgaggttttgttatgttgtttaggttggtttttaatttttgggtttaagggatttttttgttttagttttttaaagtgttggggttataggtatgagttattttattttgttttgtttggtttttattagatggaagagaagttgggttaggtgtggtggtttatgtttgtaattttagtattttgggaggttgaggtgggtagattatttgaggttaggagtttgaggttaatatgatgaaattttatttttattaaaaatataaaaatattagttgggtatggtggtgggtgtttgtagttttagttatttgggaggttgaggtaggagaattttttgaatttgggaggtggaggttttagtgagttgagattgagttattgtattttagtttgggtgatagagtgagattttattttaaaaaaaaaaaaaaaaaaaaaagttttaggagggatggtttttgttatttttttttttgttattgtttgaggtttttgttgtgggatagggaggggtatttaagtaagagggtagttttgggtttttttttttgatagggtagtatattagagttatatggggtgttttttaaaatgaaattgaggtgtttgggttgtggtattatatttgttttggtgggtgtgggtggggtttgtaatttattttgttttggggttaggtgttagggatttttttagtatgtgtaggggaagatagtttatataaagtgggtgtgtttgttggaggttatatatgggttgtggtttgtgtttgggtaggtgagtagttgtttattgggatgtttttgttgtatgtatttatgttgggttgttggtagggagttgagaggttattgtaggtggggtttttgttggaattggggattgtgatgagggttttttaggaagggttttaggaggggaggttttggtaattttgagtatttttttggggttgtgatgagtaggagaagagaggtgggaggtgtttaggatgatgattttaagtttttggggagttgtagtgttgtttaggatagtaggtgtatttgtagttgttttttttttttttaggaggtataggagttggaggtgattggtgttatagttttttagagtttgtttttgaatttgagtttggggtagtatatagtgtggaggttatgtggtaaatattagtgggtgggtagagtttgttatagggatgggtttatttttttttttttttattttagattattgtagatttgttgtttaatggtattgatgtgtatttttagaaggaatttgatgaggatttggaggattggttggtgaatgagaagttttgggtgagtggatttattaggatgttgtttttaggggatttttagtttttgttgaagggtgggttgggggtttggaggattttaagttatgaaattatatttttggggttagagggtattgagtttaggtgtttgtatttagtgttgttaggttgaggtttttgtttttgggggattttaggtttagggtagttttttttgggggtttaggggagggaattgtttttttgtatatgtgtaattaatattgtttgtttgttttttaggagatgattttatttgttgtggtgggtagtgattatgagtattaggttaatggtaagaggatttttgggaggaagattaagtggggtattattgaaggtatttgttgtaggtgttggggttttagatagatgggaagatagttttttttgttgatttagagtttgtgggttatgtttgagttagggatttgtggaattttatttattgttttgttttatttagagggaggggtttttttgtttttatttaatttttgggaaagtgagagggtaagtggtttgtgtagatgtttttattttagatttttttttgggtagggaaagatttagggagataggagttgggatgggggttgttaagttttggattttggtgtaggtttttttataggtatttgtgtggttttggataaattgtttaatttttttgggtttagaaaaggggtgggttgtagttttgtgagttagatggatttttggttttttattttgttgaagtttttgggatttttatattttagttttttgagtggttgttgtaattaattagtataaatgaggggatttaaaataatataaatgtatttttatagttttagaggttagaggtttgaaattaggggttgtttttttttgaggttttgaggattagttttatttatgtttttttttttttggtggtgtttggtatttttagttgtattgtaaaggtattatatgttttaatttttgttttattgttatagggtttttttttttgtgtttttgttttgttttttttttttttttttttttttttttttttttgtttgagatggagttttgttttgttatttaggttggagtgtagtgttgtaattttagtttattgtaatttttgttttttgggtttaagtaatttttttgttttagttttttgagtatttgggattatagttatgtattatttatttgatttaatttttgtatttttagtagagataggattttgttatgttggttaggttggttttaaatttttgattttaggtgatttgtttattttgtttggttttttaaagtgttgggattataggaatgagttattgagtttgtttttttttttttttgtttttggataaggatgtttgtttttggatttagggtttattttaagtggatgattttatttggagatttttaatgaatttataaagaaagatgttttttaagtaaggttataattatgggttttaaggtttggattttgattatgtttttgaatggatgggagtttttggggggttatagtttaatttatttttggtggtgatattttgggagggatgggtttgaatgttttttttttttttttttttttgtttttttattttttattagaatggaagaggggaaggtgtagagggaaatgtagtaggaaaagttattttgttttgggagagtatttggttgaaaggtttagtagagtaggaagtataagttttttaattttttagggttttagtttttattatttataaagtgggtgtagtgtgttaagattttagtgagttgagagattgttttaaagattatagagttttttgggaagttgttgttttaaaaaaatggttataatgataattattaggaggtattagatatttttgtgttattggttagatatgggttattttgttttatgtttgaagttttttgtatttattttttttgtagagttgaagaggtgttgtgagtagaaaatttgttaagggatttagaatgggaggtggttttagaatttatagttttagttttgtattagatttttttgagatgggagtttatgtttggaggagggtgtggagaggtatatgggttttttttttgtttgtattttttttttattattatttttgttgggtttattttgtgggagttgtttagttgggtgtagtttgggtgttttttagtatttgtttgtggtgttaggttggtttgtttttttttggtttttttgtttgtagtttttttttttttttttgtttaaagagtttttgttgtttaggaaattttttatgaaaggtaggtttgggagagttagggatggatgggtttgggatgggttggtggttttgttatgggtgtgtttttgttgtattttggtggttaattttgagtattgtaggtggttggtgatagaaattgttaggaaatgtataagagagaggtttttgtatttttttgatttgtgtgttgttgagtattattggttttagttgaggaagagtttggaatttgttaggatagttgtgaggtggtggggtttattttttagtagttttatatgaggattttggaaatgtgtttttagtattgttgggtttttatattaggggttttatgagtttatagttgatttgatatttggattagtaagggttgtgttttgtttttgttttttatttggtgaatagtattttgaggtattttttttatttttagaaattattttaagtattgttaatagaaatgtggggtgtaattgattatgttatgaatttatttaatttttatgtttttgagaggtgggtgatgttattatttatattttatggatgaggaaattgagggaatgagagtaatttgtttgagttagggagtggtgattatatattttaattttagtttgagagttttattttttttgttggtttttgttgtttgttagtgttagatgagagtgttgttggttagtttgtaggaggttttagtgtggatattgttttatatagggttgtggtaggagggtttaggtaaaggtaattggtatagtattgagagtatttgagggttgggtaaggtggaggttttggttttgtttgttggtttattaagtaaaaattagatatttttaatttggggaaaagttatgtggttttgtgatggggtagtttggagttaggtgtatgggttttgtattttgttttagttttatgtattgtggagttgagatagatatagtttttgtgttttttatgttttattttttttttttttttttttttttttttttttttttttttttgagatgaagttttatttttttgtttaggttggagtgttgtggtgtgattttggtttattataatttttattttttgggttttagtgatttttttgttttagttttttgagtagttgggattataggtgtttggtattaggtttggttaatttttgtatttttaatagagatgagattttattatgttggttaggttggttttgaatttttgattttgtgatttatttattttagttttttaaagtgttgggattgtagatgtgagttgtggtgtttagtgtttatgttttatttttgtaagataatggggataataaaggaattataagagatatttgtaggtgtgtgaagatgaagtttattatatgggagggtattgggtgtttttatttgttttttttgtttggttttttatttttagtgatgttgtttattgttttttttgttaaaaggttttttgttatataatagttatatatgttaggtattgtgtgtttatataggagttatgaagtatagtaataaaatgattattttgagatggttattagtttgagtttgagggtatttgtgggtgtttgtggttttttgtttagtttttttgagaagtggttattgttttgagtttgggtttgtatgtattgtgtgaagtgtatatgtttttgagtaatgtttagtattgttgatttttgagtttgtgaatggttgtttatagtatgtagtttttgtgtgtgtttttgtgtgtgtgtgttttgagtgtatataaggtggatggggttgtgggggtaatattttgtgggttataggttttttttaaaattttagttttgatttttgttttattttatttttagtagtttagttttttgtttgtttttaggtttttgttgggatgttttgttttttttggttattttagtggtgtgggggtttattgttttggtttttttattgtggtttttttttatgtttttatttggtttggttattgtgttattttttattagttaggaattttttggagagtaggagttgagttgtttaggagtaggagttggtgttggttattttagtattttttagattgagggtagtgttaggtgttttatatttagttgtagagtaggtggtttttttgtttttttgtttatggggttgtttttagattttgtttttggtattagtatttttgggtagggggagagaggtggggtttgggtagagtttttttattgggatattaaagttttttttgtttttttttttagttgaaaatattatatattgtgagtttgtttatttgtgggatttttttattaggtgagagatagggtgtttgggtggggttgatggttttatttttaagagggttttatagtgggtgggggtagtgggtgtggggttgaagttttgggtagagtgggtgttttttgttatttgtttgttttgtttttgggaagattttggaagtttattttttgaaaaagaaaatttattgggaaatgaagtaggtagtgaagattttttttaatttttgtgaagttggttggatgggaaggttgagttttgatttattgtggtttggtttgttagagttgtttggtggttattaagggtttagtgaggttttatgtgtaggttttgttggtagtgtggggtgtttttagttttgattttattggtttttgatttttattttttttatttggttgaggtttttttttgttttttttgagtttaggtaaggaggggaagttttgatggagagggtgttgggtgggtggtttttggagtgtgggttttggtttgggtaggtttttttttagtaagtagttggtatggatgatgggaatgttattaagaggaggggtttttaggttggtgggggtaggggtggggggattttgggagttgttttgttattgtggggatattgggttttttaatttttttttagattattttttttgagttgtagaggaatgaaaatttgagtttaggattttttttttttggggataagggtaatttagttttttgttttaggttatttgtttgttataggttatagttttggaggttggtggttatttattgtttttattttgttagtattttggatattggtttggagtaataatgttttagttttgtttttttgagtttatgtattgtttttgggttttggatttagggttatagggtggatttagagggagatatatgtattggaatatgtgtgttttgattgagtttgggtttattagggggattgattttttttttaaaatgtgtattagatttggtttaatatggtgggtttgggggattttatggggagttaagtagttgggatggggagtgggggtgggggtaggtgggtttgagtttgaggtaggttgagtagggtttttgttttgttgtttttattttgttgtgtttattttattgatttgtttgttttttatttttataggatgtatatgtagaatattaaggatattattagtagtatttattttgaggtgtattgtgtgaagtgttttaatgagggtagtagtgttatggttaatggtatggaggagaaggagttagaagttttggagatgtagatgttattttgtttatttttgggattttgtttttaagttatttttgtttttttttaggtttttttattattttattttattttatatgattttttttatttgttattgttttttatttttttgatatgttgttaggaaataagggaaggggtttttttttgagtgagttagtgatgaggttgtggtttttttgaggttgtggggaggttgtattggagttataggtaggggtgagagtatttattgaattgatatgattttttgtttttaggtttggttttttgagggtttagaagagtagttttggtgtgtagattatttgtttgtgtggggtttttagtgttggaggttttggggtgggggttaggttttgtatttgtagaggagtttagtgggttgtatgtttttttttatttttattggttttgttttttggagtgtgttagagtttaggggagaatgtagtttattaggagtatttggattttttgtttgttatatggtgtggttattatttagtttttatttttgttttgtttttaagggtagaaaattttagggttttttgttattgattgtttagttattttaagttttttggtagttgttttttttggagtagaaagtgtttttattttagttatttgtagattgtttggttagatgtggggataggttggaatgagggaggtgtttttatttttttgttattttttttttatgttatttttgtttttattgggttgtaggtgttgttgatgtgttgggatttgattgaggataaaaaggaaggagagatgatttttatttttttattttttagttttgaaaaggtttaagtaagtgagtttggtggaggagttgagggagggagttatggaaggtgttagaaggaaggttggtgggggtatgtgtgggttgtggtttgggttggttagagtggtgtgagttgtttggtgtttgttttgtttaagtgattagggaagtgtgtgtgtgtttatgtgtatgtgtgtttgtttgtttgtttagtgtttgggtttggtttaagattgggttgtagttatattaatgtttagttagttatttttgttatttattttttttggtttaggttttgttgattttttgagttggggaggtgggaggttaggtgagtttgattttgttgatttatttgtgtttgggtttttttttttagagtttatggtaatgaatttttagaaaggagagaatgggtgttaggggtgtatagtttatagttgaagagtaaggttttgtggtagtatggtttggttttttattttttgtttttatgaggggatttatgggggttgtttttgtagggtatagatgattaaagtttttttttgttttttgttatttgttttgtttttggggagaaagaggggtttgatgagattttatttaggtgtatatattattaggtgtatttgtaggtattgggttggttgtttgtagttaggagaaggttagtgagaaggagtgtatgagtgtgagtgtgtgtgtatggaagttggggtattgggtgtttgattttttttttatttaagagaggaaggattttttattatttttattggtgagatagtttattttgttaatttgttatgtttttgttaaaattaagattttgaaggaaatgagtggttagtgttagggtttaggttatgtggtttgtttagttttaatgttatttggtggtggggtggggtgggggtgggtagtagtattttagttttgagatgttttattttttttttttgtaattagattttgaaaaattgtttgttttattaggttttgttttttaatggttttttgttatgtgttttttgagaaatttgtttttttgtataaatgataaagtgttgaaaatgtattttttgaaataaatgttttaaatgtagaaattta

SEQ ID NO: 11 - DNA, 219909 bp, Artificial Sequence
  chemically treated genomic DNA (Homo sapiens)
tgggtttttgtatttgaaatatttattttaggaaatatatttttaatattttgttatttatataaaaagataaattttttgggaggtatgtagtaaaaggttattgaggaatagagtttgatgaaatgaataattttttaaagtttggttatagagaaggaaagtgaagtattttaaggttgggatgttgttgtttatttttattttattttgttattaagtgatattgaggttgggtaggttatatggtttgggttttggtgttggttatttattttttttaaaattttggttttggtaaaaatatggtaagttggtaaagtaaattgttttattagtgggggtggtgaggggtttttttttttttgggtggggagggagttagatgtttagtgttttaatttttatgtatatatatttatatttatatatttttttttgttgatttttttttggttgtaagtagttagtttggtgtttgtagatgtatttggtgatgtgtgtatttgagtggagttttattaggtttttttttttttttaggagtaagataggtaataggaagtaggaagggattttggttatttgtgttttgtaaagatagtttttatgggtttttttgtggggatagagggtgaggggttgggttgtgttgttatgaaattttgttttttagttgtggattgtgtatttttgatgtttgtttttttttttttaggggtttgttattatgggttttgaggggaggggtttaggtatgggtagattaatagagttaggtttgtttggttttttatttttttagtttagagagttagtaaggtttgggttaggaagggtgagtggtaggggtggttggttgggtattaatgtaattatagtttagttttgggttaaatttagatattagatagatagatggatatgtatatatatggatatatatatatttttttggttatttgggtagggtaggtgttgggtagtttatgttattttgattagtttaagttatggtttatatgtgtttttgttaattttttttttggtattttttatggtttttttttttagtttttttattagatttatttgtttagatttttttaaaattgggggatgagggggtaggggttattttttttttttttttatttttaattagattttagtgtattagtagtatttgtagtttggtgggggtgggggtggtgtgagagggggatggtagggagatgaagatgttttttttattttagtttgtttttgtatttggttaagtagtttgtggatggttgagataaaggtattttttgttttaggaggggtagttgttagggggtttggagtggttgggtagttggtggtaggggattttggagttttttatttttaggagtagggtaggggtaggggttgagtgatggttatattatgtggtgggtagggggtttaggtgtttttggtgggttgtatttttttttgggttttgatatattttaggggatagggttgatggggatggaggggagtgtgtagtttattgggtttttttgtaagtgtgaggtttggtttttattttaaggtttttggtattgagaattttatatagatggatgatttgtatattgaagttgtttttttgagtttttggggagttaggtttggggatagagggttatgttaatttagtgggtgtttttatttttgtttgtggttttagtgtagtttttttataattttggggaggttgtggttttattattgatttatttggagggaggtttttttttttgttttttggtagtatgttgaaggggtggggaatgatgataaatggagaaaattatataaaataaaatggggtggtgggagggtttggggggggatggaaatgatttgggggtaggattttgggggtgggtagggtggtgtttatatttttggggtttttggtttttttttttttatgttgttggttatggtgttgttgtttttgttgaggtgttttatatggtatgttttgaagtggatgttgttggtgatgtttttgatgttttgtatgtgtgttttgtgggggtggggggtgggtgggttagtgaggtgggtgtagtggggtgggggtagtggggtaggggttttgtttggtttgttttggatttaggtttgtttgtttttatttttattttttattttgattgtttggttttttatggggttttttaggtttattatgttggattagatttggtatatgttttgggggaagggttagtttttttggtaagtttagatttggttagaatatatatattttagtgtatgtgtttttttttgggtttattttatggttttgggtttagggtttagggatagtgtatagatttagagggatagggttggagtattgttgttttaggttggtgtttagggtgttggtagggtggaagtagtgggtgattattggtttttaggattatggtttgtggtaggtaggtggtttggggtaaagggttgggttgtttttgtttttaggaaaaaaaagttttgggtttggatttttatttttttgtagtttaggaggaataatttggagggaggttggaaagtttagtatttttataatggtagaatggtttttggaatttttttatttttgtttttgttaatttggaggtttttttttttgataatatttttattatttatgttagttgtttgttgaggaagaatttgtttaggttagggtttatattttagggattatttatttagtattttttttattagggttttttttttttgtttggatttaagggaaataaggagaagttttagttaggtgaaaggggtaggggttagaggttagtgggattggagttggagatgttttatgttgttggtagggtttgtatatgaggttttattgggtttttagtggttattgggtagttttaatgggttagattatagtggattaaagtttagtttttttatttagttaattttgtaggggttgaaaaggatttttattgtttgttttattttttagtgggtttttttttttagaagatgggtttttaagatttttttgagggtagggtaggtaggtggtagggggtatttattttgtttagggttttggttttatatttattgtttttatttgttgtagggtttttttaggggtgaagttgttagttttatttaagtattttgttttttatttgatgagaaggttttgtaggtaggtaaatttatagtgtgtggtgtttttaattaggagaggagataggaggggttttaatgttttagtggagaaattttgtttggattttatttttttttttttgtttagaaatgttggtgttaaaagtagagtttgagggtagttttatgggtaggagggtaggggaattatttgttttgtagttgagtataggatatttggtattgtttttagtttgggggatattggagtgattagtattagtttttgtttttggatagtttagtttttgttttttagaaagtttttggttaatgggagatggtatagtgattaggttaaataggagtatggaaggaagttatagtggagaagttagggtagtgggtttttgtattattggggtgattagggagagtaggatgttttagtaggggtttgaagataggtagggggttgggttgttgggaatgggatgaagtaggaattggagttgggattttaaagaaaatttgtggtttatagggtgttatttttatggttttatttattttgtgtgtgtttagagtatatatatatagggatatatataggggttatgtattgtggatgattatttataagtttaagaattagtaatgttaaatattgtttagggatatgtgtattttatataatatatataagtttaagtttgggatagtggttattttttagggagattgggtaggagattatgggtatttataagtgtttttgggtttgagttggtggttattttagagtggttattttattgttgtgttttgtaatttttatatgaatatgtggtgtttggtatgtgtaattgttatataatagaaggttttttaataaggagggtagtgaatggtattattggaggtggggagttgggtagggaaggtaaataaagatatttggtgtttttttatgtgatgaattttgtttttatatatttgtaagtgttttttgtgatttttttgttatttttattattttatgaaaatggggtgtagatgttgggtattatggtttatgtttgtaattttagtattttgggaggttgaggtgggtggattatgaggttaggagtttgagattagtttggttaatatgatgaaattttgtttttgttaaaaatataaaaattagttaggtttggtattaggtgtttgtaattttagttatttaggaggttgaggtaggagaattattggaatttaggaggtggaggttgtggtgagttaagattatgttatggtattttagtttgggtaaaagagtgaaattttgttttaaaaaaaaaaaaaaagaaaaagaaaaagaaaagaaaagaaaatgaggtatagagaatgtaagaattgtgtttgttttagttttatagtgtataaggttggagtgggatgtagaatttatatatttggttttaggttgttttattgtagagttatatggtttttttttaagttaaaaatgtttagtttttatttggtaggttagtaggtagggttggggtttttattttgtttagtttttaagtgtttttagtgttatgttggttgtttttgtttaggtttttttgttatggttttgtgtagggtggtgtttatattagaattttttgtagattgattagtagtatttttatttaatattgatgggtagtgagagttggtaggaagaatggggtttttaggttggagttggagtgtgtgattgttattttttggtttgggtaagttatttttatttttttagtttttttatttataaaatgtggataataatgttatttgttttttagggatatgaggattaaatgagtttatggtgtgattaattatattttatatttttattgataatatttggggtggtttttaaggatgggaaagatattttaagatgttgtttattaagtgggaggtaagaataaggtatagtttttattagtttgggtgttaggttagttatgaatttatggggtttttgatataaaaatttagtagtgttgaaggtatatttttagggtttttatataagattgttggaaagtgggttttattattttataattgttttgataggttttagatttttttttagttggagttagtggtgtttaataatgtataggttagagaggtgtggggattttttttttgtgtattttttgatagtttttgttattggttatttgtggtatttaaggttggttattagggtgtagtagaggtatgtttatagtaaagttgttggtttgttttaggtttatttatttttaatttttttaaatttgttttttataaaaagttttttaaatagtaagaattttttgggtagagaggaagagaggaattgtaggtagaggggttaaggggaggtaagttagtttgatattataggtggatattggaaaatatttaggttgtatttagttgggtagtttttgtagggtgggtttggtaggggtggtggtaggggaggagtgtagataggggaaaggtttgtgtgtttttttatatttttttttaggtatgaatttttattttgagggagtttggtgtagggttggagttgtagattttagagttgttttttgttttgggttttttggtaggttttttgtttatagtatttttttaattttgtaaggagggtgggtgtggggagttttggatatgaaatgagataatttatgtttagttagtggtataggagtgtttgatgttttttggtaattgttattatgattatttttttagagtaatagttttttaaaaagttttgtggtttttgggatagttttttaatttattaaaattttggtatattgtatttattttgtggatgatgaaaattgaggttttggaagattaagagatttgtgttttttgttttattgggttttttagttaagtgtttttttagaataaagtggttttttttgttgtatttttttttgtattttttttttttttattttaatgagaaatgaagggatagagagaggaaggggaaggaaatgtttgggtttattttttttggggtgttattgttaggagtgggttgaattgtggttttttaggggtttttatttatttaaagatatggttaaggtttaggttttggaatttatgattgtgattttatttggaaaatgtttttttttatagatttattaaggatttttaaatgggattatttatttagggtaggttttaagtttaaagataggtatttttgtttaaagataagaaggaaagagggtaggtttggtggtttatttttgtaattttagtattttgggaggttaagtaaggtgggtagattatttgaggttaggagtttaagattagtttggttaatatggtgaaattttgtttttattaaaaatataaaaattaagttaggtgggtggtatgtgattgtaattttagatatttgggaggttgaggtaggagaattatttgaatttaggaggtagaggttgtagtgagttgagattgtaatattgtattttagtttgggtgatagaatgagattttgttttaaataaaaaaaaaaaaaaaaaaaaaggaagaggagggatgggatagagatatagggaagaaggttttgtgataatggggtagagattagagtatgtgatgtttttataatataattaggaatgttaggtgttattagaaggaggaaggtatggatgaggttggtttttagggttttagaaggaaatagtttttgattttggatttttggtttttggaattgtgaaaatatgtttgtgttgttttaagtttttttgtttgtgttaattggttataatagttatttaagagattaaggtgtgagggttttaggaattttagtagggtaaggggttgagggtttatttggtttatagagttatagtttattttttttttaggtttagagaggttgggtgatttgtttagggttatataggtgtttatgaaagagtttgtattaggatttagaatttggtggtttttattttagtttttgtttttttgaatttttttttgtttggggggaggtttggggtggaggtatttgtataggttatttgtttttttatttttttaagggttgaatggggataaggagatttttttttttgggtggggtaaggtagtggatgaggttttatgagtttttggtttaggtgtggtttataggttttgggttagtagaagagattgtttttttatttgtttggagttttggtgtttgtggtgagtatttttgatggtattttatttggttttttttttaaggatttttttgttgttgatttggtatttgtggttattgtttattatagtaaatgggattattttttggggaatgggtagatggtattggttatatatgtgtgggaaggtaatttttttttttgggtttttgggaggagttgttttgagtttggggttttttaaaaatgagagttttagtttgatagtattgggtatagatatttgggtttagtgttttttggttttaagaatataattttatggtttaaggttttttaaatttttaatttattttttagtaggaattgggggttttttgggaataatattttagtggatttatttatttggaattttttgtttattagttggttttttgagtttttattaaattttttttgggggtatatgttgatgttgttggatagtaggtttgtggtgatttgggataaggagggagagagatgggtttatttttgtggtaagttttatttatttattggtgtttgttatatgatttttatattgtgtgttgttttaggtttgggtttaagggtaggttttggggggttgtgatattaattatttttaatttttgtgttttttggagggaagaggggtagttgtaggtgtatttgttgttttgagtgatgttgtaattttttaggggtttaaggttattgttttgagtattttttatttttttttttttgtttattatagttttaagaaagtatttagggttattgagatttttttttttgaaattttttttaaaaaatttttgttatagtttttagttttagtaggggttttgtttgtagtaattttttagttttttgttagtagtttgatatgggtatgtgtaatagaaatattttagtgagtggttgtttgtttgtttaggtatagattatagtttgtgtgtagtttttggtagatatatttattttgtgtggattgtttttttttgtatatgttgggaaggtttttgatatttggttttaggatggagtaggttataggttttatttatatttattgaggtagatgtggtgttgtagtttaggtattttggttttattttgaaaggtattttatgtggttttgatgtgttgttttgttaggaggaagagtttagggttgtttttttgtttggatgtttttttttattttatagtaggggttttagatggtggtggagaagaaggtggtagagattattttttttgaaatttttttttttttttttttttttgagatggagttttgttttgttatttaggttggagtgtagtggtttaattttggtttattgaagtttttgttttttgggtttaagagatttttttgttttagttttttaagtagttgggattataggtgtttgttattatgtttgattaatatttttgtatttttagtagagatggggttttattatgttggttttaaatttttgattttaagtgatttgtttgttttggttttttaaagtgttgggattataggtgtgagttattatatttggtttagttttttttttatttaataaaaattaggtagggtgaggtgaggtggtttatgtttgtaattttagtattttgggaggttgaggtaggaggattttttgagtttaagggttagagattagtttgggtaatatggtaaaattttgtttttattaaaaatataaaaattagttagatatggtggtgtgtgtttgtaattttagttatttggggattgagtttgggaggtggaggttgtagtgagttatgattgtgttattatattgtaattttggtaattgagttagatttttttttaaaaaaaaaaagggggggtataaaataaggtgggttatgttgtatggtttttgtttggttttattttttggaagagagatttattatttgtttggtttaggttttttttaaaattttttttagagattttgttggagaattggtatttttataaagttgtttttgagatatgggggagttggagaggttattttagggatggtttttagtagttatttgggttagggattattaggttagttatttgttggggagagtgattagtggtttggtttttttgatagtgtgatttttttagatggggtggtttttgttaggtttgtagtgtttttaggttgtatagaagggttggggtaagtagagatggaattttatttgttgtttgaagtggatttttttttttagggtgagtgtgtttgttttggtgatgatagggatgatgttgattattttgtttaggtgttttataaatttgatgtttaggggtttgaggttgaagtagagggatgtgtgtgaggtttatttgggggagtggggtagtgggggggtatttatttttaagtaggtgttgatatttttaggtgttggtttggggtttatgggggtttttgttggtaaggatagggttttgggttgagttggttatgttgtgagtgtggggtagaggaaggatatgggtgtgttttagatataggtgatattattgtataggttaggtgggttagggttagttttaagtatttttgtttatgagttttggggttttaattatatttttatatgtttatatagaagggttgttgttggtttagtagttgttttgttgtggggttttggttgggaggggagaggtaagagaaatagaagttagtattagtgtgtggtgtttttgtattaggtgggttgtttttttgtattaggtgggttgttttttttgtttgtttggttttagtgagtttggggtttgatgtggggaaagttgtgggtggtaggggttggtagggttttggaattggggtattattttttttagttttggagttgagttttttttatagtgagaataaattggttatatatatggttggggagaagtttgttttgggtagaagtttaagtagagatggttaaggtttgtttttgttttatgggattggatgttttgggtgggattaggtaatatgtttagttggagttttagttaaagggttagtgttggggagtggtagaagtgttatagattgtttgtttgtttttggtttgtttagttggtattaggagaggtttttgttttttgttattagttttagttgaggtaaagtttggagtagttggaatagttgttataggattgtaggtgagttgttttgtttgggagggtagatgtttagtttaggagaggtttatggatagtgggttggttttttgtttttgatttttgttggtttatagaggatgatgttagagggtgggtttgaaaattttggtttgggtttttttatagattttgggtgaggtttgttgtttattagttaggtttttttttgtatttggtgtttatagagtatggtttttttaaatttttgggttttttttgtttagggaagtatatttgggatagtaggtgtgaaggattttttttatttatttatgtagataagttatttatggttgtttttattagttatttttgttggtttttggtttttttttttttagttttggtttagggtgagttataggtgtttggtagggggtgtatagggagttgaggatagagggtttgtgaggttatgaagagtttatttgttagggtatatgtagttttttgtttttgttgatttttaggggtgatgttaggtgtggatagagttggtgggaggaaagggtttttattaatattaatagtagttttgtttagttttggaaggggttagtattgatttttgtgttttttgtttaagaatgtattaaattttttaaggggttttatgaggtagggtttggatgagaaggttagttattgttatgggtgtttggttgggggtttttattttatttgttagagtttggtttgagaaggtaggatatagattattaggttttagaatagtttagggtttgtttgatttttagttttttaagatgtagttgaaggatgggggttgggtaggatatttgtataggggttagtgtgaggttttggaggtgtagatatggtatatttttaattttatagttggtggttatggtttttgatttagtttttttgtatttagtagtagggtagatagtattgttttgtagttttaggggatagagggaatttagggtatttggtatgaggatgttgatattgtagggatgtatgagtggttggtggtggggatgaagtagaggtagtagtggatgtgggtgtttgggatgtgttttttgtggttgatgttgatttttttttgtaggtattttttgtattggttattgatgaattttatgatgggttgttagttgtgtgggggatggggatgagttagtaggtatatgagatgttttttttaagtaggttgtgtatttttaggatttagagtttaatattttattttttaatgaaatgtatgttttgggaggtttggtttgttgagtggagatgttatagttttatttttggttttttaaattagtttttttgggttggttttaggtgatgagttggggatagtaagattttttaggtaattttgttttggtttagaatttttaggtttttgagatgtgtggttttggtagtatgttaggttttaggaggtgggttttgtatttttgtgggttgggaaatttttagggttgattttgggtggggtttagggagttttgaagtttttgttagtgtttttttttttggaggggttttattagtttttgttgttgatgtggtttttgaattttggtgtgttaattattgttagttttatttggatgtttttttttttaatatttgtatagagttatggatgtagagttagaggggagatggaagatttttatagatattttatatttgattgattttggggtaattttaggtaggtagtgatgataattaaggagatattgggaaattaatggttttttttagttaattttggtataggttggtgatggtttttttgggagttttttgtttgttagatttttggtggaaaatttagttgtttgtggggagtttagtgtgatggggtttataggggtttgggatattgatttattatagttagagttttaatatgtttaatatgttggggatggtgggtatagtgagtttttgttttggggatttgggattgtttgatttgggtatttttatattgtattagtgttttaggaaggtatgggtattttatatttttagtttatttttagttattgattgtgtgtgatggttttgatttttaatttttgtgttttaggaaggtaggggtgttttgtatttttagtttatttttggttattgattgtgtgtgatggttttgattttttattttgtgttttaggaaggtagaggagttttgtatttttagtttgtttttggttattgattgtgtgtgatggttttgatttttaatttttgtgttttaggaaggtaggggtgttttgtatttttagtttatttttggttattgattgtgtgtgatggatttgattttgatggttttggggatgtgtttttttgaggtgggttgtattgatttttggttgattttggatttgaagagggtgttgattaaggtggatttatttaagttgttttgttttggggagaggatgggaggttggttaggggtttttttggagagattagtagggtttgtatatggggttttttttatttaggtatgaggttttttagtttgagatttagtagtgtttgggttattttttggtaatatttttgttaagtagtttttgaggattttatttttgagttgggtgtttagtgattgtgtaaatttatatagttgggttttgatgttagtataatttaggttatagtttttttttgagaggtgagttgggtttgggagagttggtattttttgtgttttttgtgttttttggataggaggttttttggtggtttagattttggataggatagaggttgggttggtggaggagtttagggttgtttagggtgtattaggtggttgggatttttgtagtttattagggtggttgtaattaaagtttaggtgtttaaattgtttttttttgattggttagggtttgggtaagttatttgattttattgtgttttagttttttgatttgtaaaatgggataaatagttttttttttgtggagttggtgtgagtattaggtaggtttatgtatgttttatggggtttgtggggttatgtgttagggggtgttggtttgtagggtggtgttatttgagggatagtgattgtgtgtgtagatagttagtttataggtgattgagataaatgaggatgaggaagtagtatttatatgtaatataatatatataatttatatatattttatatatatattttataatatatatattttatatgtataatttataatatatatataatttattttaaatatattttttatatatattttatatataatttttataatatatataaataaattatatataatatgtgtgtgtgtgtgtgtatatatatatatatatatatatatatatatatatttttttagatttggagttttattgttttattttgtatagagttgttttgggttatgttagtaatatattaaaaaaaatattttaggttaggtgtggtggtttatgtttgtagttttagtattttgggaggttgaggtaggaggattgtttgagtttaggagtttaagattagtttgggtaatatagagagattttgtttttatattaaaatgtaaatattggttaggtgtagtggtgagtatttatagttttagttatgtaggaggttgaagtaggagaattgtttaagtttaggagtgtgaggttgtagtgagttaggattattgttattttagagtgatagagattttgttttttaaaaaaataaaaattggttaggtgagatggtttatgtttgtaattttagtattttgggaggttgaggagggtggattatttgaggttaggagtttgagattagtttggttaatatggtgaaattttgtttttattaaaaaatataaaaattagttaggtatggtggtatatgtttgaggtatgagaattatttgaatttaggatgtggaggttgtagtgagttaagattatgttattgtattttagtttgggtaataatgagattttgttttaaaaaaatataatataaaaaatattttaaattatattgatgttttgattttgataatatttttttaggaaaagtgtgggtttttgggaggatagaggttggtgttgggaatttttggtttgaattgtttagtagtttaaggatggatattttttgtttatttttttttgtttattaggtttgtgttttggttaattttaggttaggagttatgttaatgttttagttatgatattttagatttaggagatgttaattgggatattgtaaggtgtatttttttattattgttatttttattattattattattattattattatttttattattattattatttttattagtattattattataatattattattgttattattattattttattatttttgttattattattatttttgttatttttattattattattattgttattataattattagtattagtattattattaattatattattattattattttattattattattattaatattattattatttttattattattattattattattaatattattatttttattaatattattattatttatattattattataattattattattataattattattattattttttttattattattataattattattattattattattattataattattattatttatattattattattatttttattataattattattattatttatattattattattatttatattattataattattattattatttttttattattattattattattattattataattattattattattttttttattattattataattattattattattttttttattattattataattattattattattttttttattattataattattagtattatttttattattattattataattattattattattattattattattattattattataattataattattataattattattatttatattattattattataattattattgttattattattataattattattattatttatattattattattataattattattattatttatattattattattataattattattattattattataattattattattatttatattattattattataattattattattatttatattattattattataattattattattatttttattataattattattattatttttattattattattattattattattataattattattattataattattattattataattattattattattattattattattattattattataattattattattattattattataattattattattattattattattattattattattataattattattattattattattattattattattatttatattattattattattttattattgttattattattattattattatttttattatttttatgattattattattattatttttattattattattattattattataattattattatttatattattattattattttattattattattattattattattattatttttattatttttattagtattattattttattattattattgttattattatttttattatttttattattataattattattattattgttgtaaatttttgaataattataatttgttggggattttgtttggggtttagtttgtttgattttattttatgggatgattttattttatggatgaggaagttaaggtttatagaggaggagtttaggggaagatatataagttttattttgttgagttaggataaagttgggattttttttggggtttgtggatttttaaataggtgtttttttattttgtttgtatttttgtaggtgggtatagttgttatgggagggaggagggaggagagtagagttgttttatgttttgttttttatttggtatttttgggagggagtgattttgtggggaattaggattattgttttttttagggttgaaagggtgaagaggtttagataggtgaagtggttttttgtgtattatttttagagggtaaggttgttatagtggtagttatggaaggtgagggttgttgggttgtttttttttttttttggggttaaagttttggaagaaggtttgtgttatggttgggatgtagaggtttttaggttttttttattttgtttttggttagggagtagggtagtttttttgtagtttatagagatgagttttagtttggttattgtttttgggttttttttttttttttttttttagttatttttttgggaggtagttttgaatttttagggtataagtatgttttttataataggtagaatagggtgggggttgtaggaggggattttatatttttgtttttttttgaagtaggttgttagtttttaggtagttgtgagtatagtagggttatgagtagttgggttttatgaggttataggaagtagagaggatattaagattttaggggagttagggtttagattagtgtagaagaggaaagaaaggtgttgggttggtaggtgtgggtttgtgtttatagagttgggtaggaaggatgtgtatggttggtaaaggttagagaaataggtttggtttgagaggtgtttagatattttgtagaaattttgtaagtttatttttgtttagggtgtgatttggtgggggtatttttttagatttttttttggattttgtggagtgggtagaatatagttttgggagttaaaatggtggttgtggttttttgttttgtgagttaaggaattttggtagttttttttgagttttgtttttgtttggaaaatgggatgttttttttatagggtttttgtgaggtttgaatgggatttggggggttttggaaataataggtggtttattgtagattttagtttggtttttttattttgtttaggttgtgttgattgatgattttttgtggtgatttttagttttttggggttattagggggtgtggaagttatgaggttttaattttagggtagagttgaagttgagttgttgggaagtttttggttggggtgtggtggggtgtggtggggagtttggagggttaggttggagtaatagtgaggggatagttgttatagaattttttgtataagttgatgttattgtttagaggtagtgattatttattaggatttgttttaggttggtttgggttttttaaagttattttaggggttttggatgtgtaggataggtttttttgaggagttgttggaggttgtgggttttttttaggtgtatgtatgtatatgtaatgttattggtaatttgtttttgaggttagggttgttgttttattttatagaagggaagattaagtttaaaggtttgtgggttgttttgggggttgaggttggtttttggtattggttgagtggtatgtaaggtgaggatttattgattattatgatgttgaatttgaagttttgttttatggttttttggtgtatttgttttaggatggagttaatttttatgtagttgaagtttattggggtttttttgttttgtgatgtaggtgtttgtttgagtttggtatttttgggggtgttggttatgttgttaatgtagttgggagttgttttagtggttggggaaggaatagtagaggagttagagtggaataggggtttatatataggtgtttgttaggtggttgttatatttatttttggatggggaaattgaggtattgaggtttagaaaggttaagtgatttgtttaggtgatttttgagaatttttttgggtggatgtttttggttgtggtgttttttaaaaagttgttattttgtagttatgttgtttttttagtaaagttttatttttagatttttaaggttaggtttttttatttttttttttaggagttgtgttaagttgggggttttttgtgttttaaggtagggttgattttgaatttttgtttttgtattttggagggttgtttagataagggtggagggtgttttttttttttggttttttatattgttttgggttatttaggtggatttggtttttttttttatttttatttagataagttgtattgtttgttgttatttaaaggttttagaagttgatttatgagttaagatataggagggatggttttgtaagaaatggggatagaattagtgtgtgtttttgttttttatatttttatggatggttttgtaagaaagggggatagaattagtgttggtttttatggagttgtgtgtttaattttatagaatgagttagtagttttgggagaaggaaaagtgttgggtgtagggtgggtgtttggatgtagagttgtttttgggtttatggaggaggggggtttttgtattatatttgtttttttttggattgatttaggtggttgttttgtgtgtttggttagtgtttatgggttgtatatttataggttaagattaagttttatttttgggtatgtggggtatgtggagttgaattttttgaaattattaaagttttttttgtttgtaggtttttttgatggttttgtttttggttgttgttaagatattatatatgggttagaggtttggggttgggggtggatgtttggaagatgtttgttgaggatttaggtgtttttatatagtggggttttaggggtatttaggatggggttggtttttattagggttggttggtatatgggttaggttttagtatattttagatttgttatatttattggtgtatgtgtatgtaggtgtagataatttgttggttatagaggtggtgtttttgttagtttttataggttggagttgtttttggtggtttttagtttttatgtaggttgggtggttgttgttttgtgtttttgtttttgtttgggtttatttaggttttgttttgtttgtggggagatttttgttttattttgttttttagggaggatttggttttaggtattttgtgttaagatagggattatatggtatgtttttaggtagggttttttttgttagttttttgggaggggagtggtttttttttgggattggtgggtatttagtaggggtagttataggggagtggagttggtgtgggagttagggttatagtatgggaggttgtagggggtttattttttgtgataggtaagtgagtagtttttttagataggaggtagtttttttggtttatgtttattttttattttgtttagaaggtgggaggtaggtttttaggttaggaggggtagtgggagattttagtttaattgtttttttatttgtggggtaagaattgaatttaggaaatgtttattgagttttttggttgtagtttgtatttttagttgatttaagttattttttttggtttattttattggagtggttagagggtgttggagggaggttttttaggtttgaggtattagaggtgagagaggaaaagattttggaagttagaaattgggggttggtttatttttataggtatttttttgtttttttagtttttatagggtataggaatttttattttatggaattgggggaataaaggaataatataattttttgttgggaaatgttaagggggggtttatatatttttattgttgagagtaatatttataggtggatttggaggttagggtttttttttttgtgtttttatgtggtttttatttaggttatgtagtttggaagtttttagggttttgtttttgtttttgttttttttttagaaatatttttttttgggtttttaggatttttaaataaataaagatatagttttgtatttggttatggattatgtggttttggggttgttttttgaagttagatatggggttttgttttgtggggtagtagtttagtttttatttatgtgattgaaaattgtttttatttgtttgtgggtttgagagttattttgtttgggattgggattagtttttatttgtttttatttttttttagtattttttaattttttttagtaggatttggggggaggtgttgttttttgaattttttttttttgtttttaatgtttttggagtttagagtgagggaggggttggtttagttgtagttgggtttttttataggtattagtatttattgtagaaatttaaattaaattaaatattttgtttattaggggttttgtttgagaaataataatataatgtagttgagttttatttttgttattgatgtagggtagtggtttgttttttgtataggtgagagttatttttgtaattttttttttgagaggtggttttgtaggttttggttggtttgtaggtaggtatgtatgtagagagtaatgtaagagtttgttttgtttttttatttggttaggtgagttttggggtttgtttttaggatttttaagtgggaaaagtagagatttttatatttagagatatttttattttggttttaggatattatggtgtttagatagttggaaataatggtaaagattatttattttattgtttgtgattatgatattgtttgaggtttgtgttgtttagtgtggtagttattggttatgtgatttttttttttaattgttataatgtttgttatggttattattttgaagtgtgtagtttagtggtgttaagtatatttgtattgttgtgtaataaatttttagaatttttttattttgtaaaataaattgtttttattaaataattttttagttttattttttaagtttttggtaatttttattttgttgtttttttgaatttgattattttatggatttggtataagtggaattttataggattgtttttttgtgattaaattattttatttagtgtaatatttgaaaggtttatttttgttgttgtaggtattttaattttttttttatggttgagttaaattttttgtatgttttattttttttttttttttttttagatagagttttgtttttgttgtttaggttggagtgtaatggtgtgattttggtttattgaaatttttgtttttttaggtttaagtaatttttttgttttagttttttaagtagttgggattataggtatttgttattatgtttggttaattttgttttagtagagatggggtttttttatgttggttaggttggttttgaatttgtgattttagatgatttatttgttttggttttttaaagtgttgagattataggtgtgagttattatgtttggtttgttttgtttttgatttttttatttatttgattgtgggtatttgggttgtttttatttgttggttattgtgaatagagttgttatgaatgtgggtgtataaatatttttagttttttaagatgttgtgtatttttttgaatttatatttagaagtggaattatgggatgttatggtggttttagtttttgttttttgaggaattgttatagtgtgtttataagtgatttttgagtatttgatattgagttagtttaattgaggaatggaatttttatttttatttaaatttaaatagttatattttataaatggtaattatattggatggtatagaattttagtttaatttattttttattaatggggaaattgaggtttatagagtgatttttttttttgaaatgttattgtaagtggttaggttagtataagatttttattgaatttggtaattttgaaattttatatttttgtttgtatgatatgtggttaatatttgtgattttttttaaagattgtgggttttagtaagatggtagttgttttgttgagatttttattgtatttttaggttttgttttgttatgaatatggttgtgtaaggatttgtttgggtttttgttttttatttttttgggtatttagattaattattagtagtatttatgttgatttttagaaaggttttgatttggatagtaattgatatgttattttatagttaaagtaaaatgtagagttttttttttggttttgtagttgggagttagaggttttaggttttggtttttggtttaaagtgattttttgtaagtttttttagtttggtaaataggttatgtattttttgattttttttttagtttttgttttgtgagtttttgggtgtttgaggttgtggtttatttagtgatatttttagtttttagtgtagtttgtgagtagtataatatatttggttttagaaataattaatatatttgttaatagatgtgtggagaaatttaatgtgttgagttaatatagtggattattttttagttataaaaaggtatgagtgtgtgttaatatagatgaattttgaaaatattttaattgtaagaaattaagtataaaaagttatattttttagggttttagttatatgtttagaataagtatatttgtagggataaagtgtagattggtgatttttaggggttgggggagggggagtgattgtgtattgaggatggtgtttttttttggggtgaggaaaatgttttggaattagaggtgatgtttatagaaggttgtgaaaaaatgttatttaattgtgttttttgaattggtggatggtgtaatatggaaattatatttttatgaggatgggagaggaagggaaagaagggaaggagggagggggaaggaaatagggaaggaaggaaaaaagggaggggaggagggagggatggaagaagggaaagaaggtagttatttttagtggagttggattgaagagtttaatgggtgtagtaaattattatggtatttgtatttttatgtaataaatttgtatgttttgtatatgtattttagaatgtaaagtaaaataaaataaagagtttagtgttttttataagtgtttaggagttagttttatagtttagaggatagttgaggtttagaggttaatatttaggtttgaggtttttaagttggtgttgttagattatgttttagataaatttttttatttttttgtagtaagggtgtttttagggtggtagttaggtggaggtgttaggtggtgggagattttgatagtttttttgtaggtttttattttgaatttaggttttatgttagggtttttttgttatttattggtgttggtggtagtaggttattggttttgtgatggggattgtttttaaatttgtttattttggggattagtttttttttttttgtaggtgtttattgggttattttttttttagagttgtaggtgggtttaaggtagggatgaaagggttgtaatttatgtagttttgagttagtattttttgggaatatttgtatttagtgataaatttttattttaattttaggatttgttgaggatgagggaattagattgttgtttgtggttgggatgggggttgtaggatatttggttgggaggtagtgtttagagaggaggtagttattggatatgatatattttaggggtatttatatttattatagttttagggttgattttggtttatttggtttggtgttgagagagggtttgatatagtaggtttgtaaagtttgatttggaaattaagatttaggggttgtttttttttgtttatttttttttgtgtgttatgttgtttggtttatgttttagaaatgtttatataagttttattagttttgttggttaaatgtagagatggtgttgttggggtaagggattttgagttattgtttaatgttatttttagttttaggggagtgatagttgggtttgtattttaggataaagtgtttagggttaagttaatgttatttttttgttttttttaaatttaatttatatttggtttttagagtatggattgaaatggttatatttttatatattttgtttgttattgttaatggtggttaagtagaatgtaaggttattttttttttgtttatggaggtttgtgaagttattgattaggttatggtaggggagttggtggtatttattatattttgttagttttttaggtttgtgtttaggagaaagttgttggtatttatagttggtgtttttgttttggtgaagatttttttgtttttatttattttggtttagtgtgggtttagtagtttttttattttgttttgtaataatgtatattggagtagtttttagttgttttttttttgtaggtttttttgaatttagattttggggttagtatttttgtggtagttttatggttatttgtaggtttttttagaaatttgagtttatgggggtattttaggttttataaattaatagatgttttttgttttttataaaggggttttttaaagttgagtgagtttttgatgtaggtaatgttaggaggatagtgtttggttagggttgtttttttttttttttttatttttttgggtgtttgtaaagttttttagatttttgttgaattttggggaagttttgttttgtaattagggtttgttttttttgtttttatatagagtttgttttttgtgtttagatagtttttttatgatggtaattgaataatgatgtgtgtggtttttttttattataatttttttatatagggtttgtgaagttagatattttatttattatgtttattttagtttggttttttttagagtagtgtagggtttatggtaagttttggtaaaaagtttggtgaatgaatgaataaatgaagaaataaagtttattatagtagttgaggtttattgggggttttttgtgttaggtgttattttaatttttttttttagagagtgggttttattaatgttggttaggttggttttaaatttttggttttaagtgatttttttattttggttttttaaagtgttgggattatagatataagttattgtattgagttttaggtgttattttaaatgttgtttaggagttattataattgatggattattatataattttataaggtagttattgttattgttttattttatagataaggaaattgagattgagagggtttttgttaattatgagggttgtaaagtgagtaagtggtagagttaggatttgaagttaggtaggtgagttttaggttgttgattttttttttaggttaggtttttgggaattatggaaaggttggagaagtatggggtttttgtagttaggatttagaaggtgtagttgtggtgtaggtagtttagtattgaggttttggtttttagttttttttttagttgtttttttttagggagttggaggtagagttttgaattgttaggagaagattttatttgttagttagggaaagttgttagggttttttttagggtttagagttattttaggtttattaaagtatattagtattttagtttttataattttttttgtaagaaagatgatggtattagttattgggttgggttgggggttttagattttaggggtttttttaggtttgtttatggtttttttaggatatagatgtttatttgagaaattttagtgtattaggggttttatagttaaaataaagaggtagagttgttttggggtttttgttaaagtttttaggtagatttatttagtagatattaaaatgtttattttttatttgaaaattttatttttaggaggttgttttaggttgggttgataaaatttatagagattttaatgatgattttttattttaggtatgagtgagtgggtggagggagaagttattgttaattattaatagtttaggaaatgtaggtaaaggaaagagaatggtaaggtgatagggttggaaattagatatatgtgtagaggtgagtagattttagagaaagaattgttttggaataagatggtaaagaaattatagataataatggtagatgatgattttggggttttagtggattaggattataatattgatttatttgataagtatttattgagtgtttattttatagtaataaaaagatgatattataggtttgagagtagttagaatgaaaatagtggtggtatatgggaatttgaagtttatttatttaaatgtttattagttgagatttttggatagatttgaagtagtttttaatatgtaaggaatttataatttgatatagtagtataggatatgtgtgtgttataaatttttggtgaaaagtaaagattttttttagaaaagtatatattgaagatagatagatagatatatatgtattttgaatggtttattaaagaatttttaggtttgtggattttagttaaaaaaataatttggtattttgggaggttgaggtgggaggattgtttgagtttaggagtttaagattagtttgggtaatgtagtgagattttatttttataaaatgaaataaaataaaatgagaattaaaaaaaataaataaatttggtgtgatgagaatttatagaatttaatagggttattttagtattatttgtagtattttttaaatttttgattatatatataaagttttgggttttatagttagagaagagggagagtaggttaaaaataattatttaaggtggaagatgagtttgagaaataaagaggtaagaggagaagattgaggttagttgttttttatttttgagttttggtaggaggaagtttttaagtgagaataagttgttgtttgtggagtggattttagagtgggtggatagagatgataaggaatgttatttttggggggttttgaaaataggatatttttttattttaattttgttttttattgtattgtgtttttattgatttatttaagttattataaatattttataaatgttattggggattttttgtttttttttaaagatggaaatattgaatataaatgattaaattgtgtaaatgtgtgtgggtgggggattaaggattgaatttttaaaatgtatatagtttatttaatttgttaattaattttaaattaaattatattttatattttgtatgggataggaagtgtttttttaaagtttggttaggatttgggatgttggaaatttgagattttgttttttttttttgagatattttgaaattttgtttagaaattgagtataatggttttggttttttagagaaagatatggatttgtaaaggtaaagagttgtatttttttttgagttggagttttttttggtttttattatggggtttaaataaaattgtagttttatagtttttttgttggtgtttttttttttttggtgattaataaggtggaagagttaataagaattttgtgtgtttttttgtaggatttggaagggataggtggtgtgagtttgtttttatttagtttttttttttatttatttaggggttgaggtgtttttgaggtagggggtgggggtttttatttttattgttggttaaggtttttttagttttttttttgttaaatttttttaagtaaattttttttttattgtggaggaaggaattttaagtagttttgtttttttgttagtatggttttaattggttttagttggtaaagttaaatttggataaggtttaagggttttttatattatttgttgttttttggaagaggtttttttttgtttttttatttgtaatttattatttttttagtttgagtttttttatttaggttttgtggtttattgagatattaattttgggttagagtaagttttgatttgtaaattattattatttattttttaaagagttatttttagaatttaggttgtagggagggtaggttaaggatgaattttttgatttttggtgtggtgtgtggtggggggggttattttatattttgttttttgttgtttttttgttttgttttaggttttgaagtggatttattgtagagggagggttagggaatggttttgatgttttttttattttaaggaattttttagtaggagtggtttttattttaaagtaattttaagatttagtttgtgttagttttttagttatgtttatagtggtttgttaattagagatttttttagtttttggtaaatttgtaaatttataaagagaaagaaaagtttttttgtgggtgggtggatattggttatttgttataggttggaatttttttttattagggatgttttttaagtaggggttggggagggtagggtttagagtttttttttttttagttttttttgttattagtagatttgttagtagatatatagtagagtttagtagtgaggtaataataggggttgtgggggttggggttttgttttttttaatttatgaaattatttgaaataataaaatttagataagggtttttggggtgtaatagggtggttttttgttaggtgttgggtagaaaaaaagtttttttttaatttttttttgttgtgtagattagtttgggttttggggatgttgtagaggttgttttatgtttaggttttttagagatagtagggggttggaggtatggtttgtttgggggtaggggataggtagggaggggtatatttttgggttatgagtaggagtttgattaaatgatttttttaggagggagaaagatattgtatataattgtttgattatagttagaggggttggaaaggtgggggaaaggggtgaaggggttaattgttttaggtgtttttaatttatgtagtatttatttggattgataagagttgagagattggaattgttttttttttttgtttttaggttttgttttaggagtttttttgtttaggagtttgggagttgaggaggtttggaagtagtgggtttatagtgttattgttttgggaatttatagtgttttggatgtggtttttttggttttagttttgtaggtagtttatttggattgtatttattttttagaagagttgtttagaattttgtatgtttgaaagaaagattaattaaagaagtgaggaagttaaagagaggtttatgaaagtttatgatgtattttttaagtgtatattttagtaattttaaatgttttttgaagtaaggatggggatggatggttggataaatggatgggtgtatgggtgtgtgaatgggtgagtgggtgggtggatggatggatagatggatgaatggatgggtaggtggatgaataggtaggtgaatggatgggttggtggatgaatgagtaaatggatgaatgattggatggatgggtggatgagtagataggtggatgagtgaattggtggatgagtggatagatggatgagtggatgagtagatgagtgaatgggtggatgagtggatgggtgggtgagtggatgagtagataagtggatgggtggatgagtggatgggtagatggatgggtgagtggatgtgtggatgagtggatggatggatgagtggatggatggataagtggatgggtagatgagtggatggatagatgagaggatgggtagatggatgggtgagtggatgggtgggtgagtagatgggtggataagtggatggatagatgagtggatgggtggatgagtggatggatatatgggtggatagatgggtgagtggatggatgatgagtggatgggtggatgagtggatggttgagtggatggataaatgggtgaatgagtggatgggtagatgagtggatggatagatgagtgaatgagtggatgggtggatgagtggatggatagatgggtgaatgagtggatgggtggatgagtgaatgagtgaatgagtggataggtggatgagtggatgggtggatgagtgtatagatagatgggtggatgggtggatgagtggatgggtgggtgagtggatgggtaggtggatgagtggatggatagatgggtaaatgagtggatgggtggatgagtgaatgattgtagataggtggatgagtggatgggtgaatgagtggatagatgggttgataggtggatgagtggatgggtggatgggtgggtgtgtggatgggtgagtgagtggatgggtgggtgggtggtaagatgggtggataggtatatggagtttatttaaggagttttagaaatatatatatatttttttattttagattttttttaggaaaaagtagtgtgtatggattgttatttggttatattttgagatagttatttttattttttttggaatattgtttggggggatgtagtatagggtatttaagtaatttttgagtttagggtagagatattaggaagtagtaggtaggttgtgattttgtaggtttgttttatggtttttgttgtttgtattatggtatgaagtttagatgtatttttggatttggggttttgattagatggagttattaattttttgaagaatgaaatatataggggttatttttgttttttagttgtagggaatgatgattatttagttttttttttttttaaattttttttaggtttttgtgtatggttttgttgattttttttttgtttttggttatttttttagtttttgttgtttttttttttgtttttatttatggagttagttttggtgttttgagagtttttttttttagttgattttatttagtttttgagtatttaatgttaataatgttattttttttgtttagatttatatttgagtgttagtttgatttatagatgtgtttttgggttttgttgtgttaggttttttgttgggttttgggtatttgtagttattgttattgttaagttttaatatttgaaggtattttgaatttaatgattgtgttttaggttgaattttggagtttttattttatttgttttttattttattttttatttaagtgaatagtttttttagttaatagttattgtagttagatttttaggggttgggtttgggttttttatttttattattttgaatttatttatttattttaaatttttattaatgttaatttaatatattttatagttattattattagttgtttttgtttgaattttttttttttaaagtattagggggtgtgtgtaaaatttattaatttgatgatttttttttatgaagttgtgattggtttttattgtatttgggatatattagatttttgtggttttagaattttgtttattattgatgtgttgtgtgattttgagtaagtaatttaattattttgtgttttaatgtttttatatgtgaaatgggataataatatttgttttataagaatgttggggattaaatgagatatttatttatgaagtatatagtgttgtgtttggttagtaaatgtttgaagtttttgttaataaaatatatgtttttaatttattttttagtttttatttatgtatagtttttttggttgttttttagtttttttaataaggttatttatagaggttttttttgttgggattattttttttttatgttgtttttagaatttttatttgtttttttgggatagtttatttatattgggttttttagtttttgttttgttttgttttgttttgttttttttgagatggagttttattttgttgtttaggttggagtgtagtggtattatttgggtttattgtaagttttgttttttgggtttatgttatttttttgttttagttttttgagtagttgggattataggtgtttgttattatgtttggttaattttttatatttttagtagaaatggggttttattgtgttagttaggatggttttgattttttgattttgtaatttgtttgtttttgttttttaaagtgttgagattataggtttgagatattatgtttagtttaggttttttagtttttatatatgtggttttttgattgttgtttggggtttgttgtatttattatttataaaattttatatgtttgaagtatttagtaagatgttgtgaatgagtgaatgaataaatgaatgaatggttagtttgttgtttttttgtttggttttttgttttttttagattagtatgggggtagttatggtttttgtttattttggtaatattgttttttttgtgttggttgtgttggttagagtttttttttatggtgtttttgtggttttggtgtgtggttgtttgtgaatgagatttatgatttttggtttttattatttttttggagttataaagtattaaggtggaaggatggatgggttttttgggatagttggggtgggaggttggtttaggaaattttttttaggaaatggttagtgtgggatgaggtgtttggtgggaggggagtggagtggggatttggggtttggttgttttgtagttagggattttaatttttatttttttttttgtttattttttaattttagtgttgggtttagggtttttggggttttttttaggaatatagaagatatagtaaggattagggatataggataggtagagtttatgggtaggaggtttttagttagtatatttgagtttatgtttggttttaattagatattgagattttggttaggttattttttatgttgaggtaggggggttttttagaggttattggtttttaagtattgtgtggaagatatgttatggagagttagtattttttgagatattagtagaaggttagatgttttgtggtttaaggatgatttggttttagtgtttatttatttgttgttttgtatgaaaagtttgatgtgatatggttggttttagtggaagagtgatttgggaattggtagagtggatttagtaattggtaaattggatttagtaattgagatattgttaggggtttggtagaagttttttaatgtattagatttagttttgatttttatagagtttagttgagtattaaaaggtgtagaggttgagttgagtattaggggaatattgattttagggttgattggtgttgtgtgtgtattttatagtttatagatggtttatatttatttgattgtatttgatttttttttgtgaggttttttttagattttttgttttttaaagttattagttgtgttttttgaaattagagtaaagtaataaaattgtagtaatagtgtgtttttatgaatgttgtgatgttagttggttaaatgagggagtttttagggttttttatattgttttgattttgtgtgttttttggttttggtttattttttatattttttgtttttttttttttttttttttttgaggatttagggtttggggttgatttattgtgggattttaatggtgattttttggaagaaatgtttgttttttttttttatttagtagtgatttttggtttgtttatgtttatgtagttaatataggtagtagttggaatttggaagtttttggggtgggagtttgtttttttttaggtttttttagtttgaattttgggaaggagttatatttatatggtaattttttttaaggttgggagggggaaggggtttggtttgggtttgattatttttttgaggttgtgtttattgggttttttaagttagttgggttttttggttgtatttttgagggatggtaatagattatagtgtaaattgtttattggttggttgggtagtgggtgtttagatgtgggttagggtttttgttttataggttgtgtggtggtttaaagtgggtatttttatgggtatatatttgtgttatagtttatttgtgtgtgtgtgtgtgtgtgtgtgtgtgtgtgtgtgtgtgtgtgtgtgtgtgtgatagtttagaaatatggtaatttatagtttttttaagatgttggttttgggagatttgtttatttgggggttttagtatttttagttttttttaggaaggttttgttttttttggtttgaagttggttttagggaagaatttttttagaaaaataaaagttattttttttagttttagtttagtttttttttaggggtgagttatattaaatttattttttttttttttttttatttttttttttatgttgtaattagttgtaagtggtttatttatttaggtttgttagtttattatagaaaagatatttgaattttgtattttttttttttgatttgttttgggttttaataggtaaaggaaattggaagttagtagttaggatttagttgtaggtttttggggttattttgtgtttttattttagttttatttatttttgtgttgatttaatgtttatttattttagtttatggagtgaggtttggatttaagataaaataaagggggttttggttttttggggtttatagtgtttggtgttggtgagataattttagagtatagtatagagaaatggttgtgatatggatttgtagtatttggttggttaagtatagtaatgtatttttattaggtttgggttttttagtagatatatggtttaaaggttggttggttaaattatatgattttgtaattatttaagagaaatgaaaatatgtttatataaaaatttgtagattagtatttattgtagaattttttataatagaattatgttaaaaagtagaaataatttaaatgtttattagtagatgaagagatatatagtgtggtttatttatgatggaatattatttggttatgaaaaagaatgaagtattagtatttgttataatgtggatgagttttgaaaatattttattaagtgaaaggagttagatattaaggttatatattgtatgattttatttatataaattatttagaataggtgaatttatagagatgaaggtagatgagtggtggttaggggttgagagtttggagttgggaatggggattggttaatgggggtagggttttttttggggatgatgaaatgtgttgggattaatggtgatggttgtgtaattgtgatggttaattttttgtgttagttgggtgtagtggtttatgtttgtaattttagtattttgggaggttgaggtgggtggattatgaggttaggagattgagattatggtgaaattttatttttattaaaaatataaaaaaaaaaattagttgggtgtggtggtgggtatttgtagttttagttatttgggaggttgaggtaggagaatggtgtgaatttgggaggtgaagtttgtagtgagttaagattgtgttattgtattttagtttgggtgatagagtgagattttgttttaaaaaaaaaaaaaaaaatttttgtgttaattggattgggttatggggtatttaggtaattggttaaatattattttgagtgtgtttgtgaaggtgtttttggatgagtttaatatttaatttttttattttttagaaagtttagtttattgttagtatttatttaattttatataaatatgttttttgaggttgaagtaaatttgattggatgttttgtgtgaaaattaaatataaaaattggttaggtgtggtggtttatgtttgtaattttagtgttttgggaagttgatatgggttaattatttgaggttaggggtttgagattagtttggttaatttggtgaaatattgtttttattaaaaatataaaaaattagttatgtgtggtggtaggtattttgtaattttagttaaatttaggaggttaagattggagaattatttgaatttaggaggtagaggttgtagtaagttgagattgtgttattgtattttagtttgggtaatagagagagtttgttttaaaaaataaaaaaattaaaaagaaaaaaaattttttaaattgtttttgtagttatttttaagtaaaataatagagttatttgagttgtttattttggaaaaattagatttattaaatgaatttttagttaataattgattaagaataatgttaatattatttgtaggaatgttgtgttttttaggatttgatatttttagtgattgagaattattatttttttttaaattttatttatttatttattttttgagatggaattttgttttgttgtttaggttggaatgtaatggtgtgattttggtttattgtaatttttgttttttgggtttaagtaattttttggttttggttttttaagtagttgggattataggtgtttattattatgtttggttaatttttgtatttttagtagagatgggattttattatgttggttaggttggtttttaatttttggttttaggtgattagtttgttttagtttttttaagtgttaggattataggtatgagttattatatttagttgagaattattatttttttttaaaggaaatattattattaaaaatggaatgttataaatagaatgatgttttttgtttttaaagttgatatattagagtgatgtgaaaataataataaaagtaagatattttttggtaaatttattttggggtgaatgttgtagttataagtattgttggtgagtatttttggggtaaataggaaaagggtgtaattaggagtttgggtaaagtagattgtgtgttttgatgggggtgggttttatttgattagttgaaggtaatagggtttggaatgtatattttaagatatagtgttttggtatagtaaatatttttagttgaaggaatttaagaaatggtaggtttaagaagaatttattgatttgttttttttttgaagtagattataagttttttatgtaagaggtgttttttttatatttagtggaaaggaatagttttatttttagagatagaggatttgagaggggttttagtatataggttttgttgagatttttatgggtttattgtttagtttattttttgttgttttgttatagttttttatgattttttattttttattaaatttagtataaaaatgtttaggtttaggttaggtatagtagtttatatttataattttagtattttggaaggttaaggtggttagattatttgaggttaggagttgaagaatagtttggttaatatggtaaaattttatttttattaaaaatataaaaattagttgggtgtggtggtatatgtttgtagttgtagttatttgggaggttgaggtatgagaatggtttgaatttaggagatagaggttgtagtgagtagagattatgttattgtattttagtttgggtaaaagataagtaaaagaaataaataaaaaaattgtttaaaataagtaataaataaatttaaaaaataagtaaaataaataaaaattgtttaggtttaggttgggtatagtggtttatatttgtaattttagtattttgggaggttaaggtaggaggattgtttgagtttaggagtttgagattagtttgggtaatatagtgggattttgtttttataaaaaataaaaaattagttaggtggggtggtatatgtttgtagttttagttatttgggagtttgagttgggatttaagagtgggtttagagtagtttttggggttggtagttgggttttagtttgagtttaggaagttaaggttgtagtgagttgtgattgggttattgttttttagtttggatgtgtgatagagtgagattttgttttaaaataaaataaaaattgtttaggttaatggtttttttgggtttttatttttttatgaaggtttggtgttaagtaaaatttatttgaattgttatgtttgttttttgttaatttttgttagtttaatttttagggttttagttaatgaatttaaaattgatagaaggaaagggtttttttttagattttgttttgattaggtttttgtaattttgtgataaaggtttgaaggtttgaataggaggatataaggtttgagtgagagagaattttttttgtttaattgtttttaatttggaatattagattttttttgttttagatttaaattgatatatgtgttttttttgggttttgggattggaatgatgttattggtttttttgggttttgggtttttaggtggatattagagttgtaatatgggtttttttgtgtttttagtttgttgatttattttgttaattttggtatttgttaatttttgtaatgaggtgagttaattttttataataataaatttttttatttaaatatatgtatatattttttattggttttgtttttttggatgattttaatataattattttgtgaatatagtaaaattattgaattgtagattttaaaaaggttaatgttatagtatgtgaattttatttttataaagttattatttaaatagtaataagaagttggtgagttttgtgtatttttttgtaaataagagtagggatagtgttgtttttgtttttggatgtttttagtttttagtttgagtttaggaatattttttatgtgtttttttttttaattttgtagtttaagggtgggggtggtttttagtttggtattttttttgtagttttttattttttttttatattagttaatggatatagaggtttttttatggatttttatttttatttatttatttttatttttttgagatagagttttattttgttgtttaggttggagtgtagtggtgtgattttggtttattgtaatttttgttttttggatttgagtgatttttttgttttagttttttgagtaattgggattataggtatgtgttattatatttagttaattttttgtatttttattagaggtagggtttttttatgttggttaggttggttttgaatttttgattttaggtgatttatttgttttagttttttaaagtgttgggattagaggtgtgagttattaagtttagtttttttatagatttttaaaagggttttgggtaatatagattgggatttgttaagttattaaatgatttttttaaataaagaaggaagttataaatttttatttaaaaggagtgggggatggtaatagaaatatagttagttagaagttggaagggttttatttaatttatttttaaggtttttgggtagaagggataagggaaaatttgttttttaaatattttatttggtattttattttttggatgtaagatgtagttgtgtatagtggtagtagtgaggattttggtttggtaggtttttatattttttgttgagggttttaggggttagggttgtttaataggattaagaggaaatgattataggagtttttagttgttgggggtggtttttgtggttttttgggttatttttggtgaatttattttaaatttggaagaggtttaagtttttttgttttttgtattttaaattttagttatgttagttaggagttttgggggatgagaaaaaatttaattaagttttattgtgttgggtgatataggatttagaaggagaggggtttttggattgtttaagtttaatgataattttagtagttgggtttttaagttaattagtttttttttttttagtagtttttggggagtattatggtgagttgtgaggagttagtttagtatggtatatataatgtaggggtttttttgtatttttattttataaatattagggttttttgggggattagttttttatttttgagttattttttttttattgtttttttaataaggaatagagaaggagtttttattgtttaattagatgtagaaattgatgtatgtatagagaggttatgtgtgatatggtttggatgttgttttttttaaattttatgttgaaatgtgatttttgatgttggaggtaaggtttggggggggtggggtttgggttatgggggtggattttttatggatggtttggtgttttttttatggttataaagtttgggagatttgattgttatagagtttgggagggttgggtgaggtggtttatatttgtaattttagtattttgggaggttaaggtgggtggattataaggttaggagtttgggattagtttgattaatatggtgaaattttatttttagtaaaaatataaaaaaattagttgggtgtggtggtatgtgtttgtaattttagttatttaggaggttgaggttgtagtgagttgaggattgtgttattgtattttagtttggttgatatagtgagattttattttaaaaaaaaaaagagtttgggagtttttttttttgttatgtgatgtgttagttttttttttattttttattatgaggaaaagttttttggggtttttttagaagttaagtagatgttggtattatttgtatagtttgtagaattgtgagttaaataattttttagttttggttattttttatagtaatttaaaatggatgaatataatgtattagtttttttttttggattttatagtgtgtttggttggggttgtgttttggggaaatggtaattgtgaggtttttatagattgggtttgggttttaattatagttgtattttagtgttttgatattgttgagtggatgtttaaaaagtattgttgggtgaatgtgtgagtgaatgatgaagatggaggtggttgttggtgttagggtaaggttttaggagtttggggaggtggtattaggtagtttaggttaatggttaattttggatagggttaggaggtagttagaatggttaaggatagttaagggattttaggtaagtggttttattttttttaggtgggtaggaagtaggaattagattaaggggtgttaggtggtagtggtatttagggggtttgaggagtaggtgtaggtttagtagggttggtggtgttatgtgtggggttgattgtggttttgtttattgtttttattttttggatgtatgggtttatggtttttaaggtttttttttgtttttatgtttatttttttaggttttatttttagatgttaagttatttttttatttttattttttttgttgtttttatatttgagttgattttttttttgagttttggtgaaattttagagagtttagaggtgtagtttatatttttgtgttataaggtttttgtagtttttatttttttgggatattttattttagagttgggtgtgtatttattttattggattagaaattttaggaatgtttattttgtatgtttttgttttttattttttgtttgttatttagtttgtggttgttatgtggttgggttttggtagttattgtagttggtaatatataattagtatttttgtgtttaggttttgtgttgagtttttttagttttatttttgtttgtttttaaaatggtttttgatatggtaattattattatttattttttagataaaagattatagttttaggagaggaggaatggtaggtttgaggttatgtggtttgtaataggtaaatggatttggtagttattttatttttgagtggggtttttttttgtttgtagattttgttgaggttttagagtttggagttagtgagtttttattgagtataaggatagtggtggtgttggggttggaataaggtagggaggggttttttaaattatagttttggttgtggatttattttgggattttgttttggttgggaattttgttttagtttatttgggatatttttttattttgagttttgtattgggttgtgtatggggtttgttgaatgagtgagggtaggagggatggtgagtagggtggaaagtgattatggtgggtaggtttttgttggaagtttgaaatatttttggtgagtaggaaaatattaggggaagaggttatagtttttagaagggtttgttggggattgttttgtagtttttttattgggataggtagaaaatttagtttttttttagggtgagtttaggaagtttgtgggggtataggttttagttagggtggtgtgtgggtttatttaggggatgttgttgtggtttagagttaggttaaattttatgtattttgtaaataattatttataataaataaggtttatttattttttaagaagagtaaaatattataggaggtatttttttattaattaaatatgttatagtgattttattgtgttattgagggagggtattagggtgtttggtttagagtaaattgtggttagggggatgggtatattgttaaattggttagatttttatttttgaaaatgtgggttaaattttttttaataagttataaggaaatttagtgtgaattttatgtttttattattattggttgttttggaagattgggaggaggggttttgttttttttttatttttggttatagggtttgaggttataatttggattgggattttaattttttttttggggaagaggtttatttagggtgtttgttaaggtttagtgtataaatatggaatttgtttaatgtttgttttggtatttttgggttttttatattgggtttttttatttgattttttaagtagtgagagtgatgggatatggggtgtttttaggggagatttggggagatggagtaagttttttagtttaaggtgaggttttgaggtatggtttatgtagtgatgttttttatgggaggtttgaggtatgattaggagtttggagatttagtagaggtttgggtatgggatttttggtatgtagttagagtgagggttgaggttgtatggatgtaagtaggtgattttgtgttattgggtgttatttgtgttgggttttgtgtagttgtttttattttattgagttttagggaggtgaggtaattattttaggtatatagttttgggggtaaaggttggatttaggtgtgtttgattttagaatttaagaagataagtagaggagtttgagttttttgagattgtagtgatggtttagtgttttaggatggttaggttggtttttgtagttttagttaattgtgtttttttttagttatttagggttttagtgttggtttttgagatttggtattggttataggggtttatttttggttgtggatatttagtgttggttattgggatttggtattggttgtggggatttgtttttggttgtggggatttagtgttggtttttgagatttggtattggttatggggatttgtttttggttgtgggtatttggtgttggtttttgagatttggtattggttatgggggtttgtttttggttgtgggtatttggtgttggtttttgagatttggtattggttatggaggtttgtttttggttgtgggtatttggtgttggtttttgagatttggtattggttgtgggggtttatttttggttgtagggatttagtattgtttatggggtttgtttttggttttggggagttagtagtgtttgtggggtttatatttggtggtggggatttggtgttggaggattttgatagtaaaattatagaggtgataggtaatagtaatttattagtatagtgtgtggtttgttttagttatggtatttttttttattttgtgtttttttattataaagtttagtgtaggtaatgaagttaagaggtggagaatttgtaggaggatgtatattatatttgttttttgtgtggtgtttttgtattttgggtggttgagattttttgttttttttttaggtttttttgtgttaggtttgtgttgttttttttggttttggtttttatttatttggttttttagttatagatagtagtgatttttttttttatttaatggggttattgtttagtttattattagtttttagggttggtagatgatattggttatgggtagtgttttttttggttttagtatataaggtataaaagatattattttgttttaagatttttttagttatgtggtgtatgggaagtggtgttgggaattttttagggtagttttttgttttgggggagattgtgtttaaatttttgaggaaatgttgttttttggttttttttttgaaaaattttttaaggagattttgtgtggagtgtgtagggagaatggagatttttgtgagattgttttgggatagttttatagaaattataaattatttggataaaagttgaaaatttgtggttatataatgttgattatttatttaaatatttgttgagtaagtatttatgatgtttgggaatttaggatgtggattgataagatataatttttatgtttgttttagtgatagagagagagatggtattattaattttgtttgttgggggtttttttggagggggtgtgtaggtttagggttgaatttgtttagtggatgtgttatttatgtttgtgtattttttggttttgtggtggtttttggaataaaggttgagagataaaagataaggatttgggggagggaggatgtttatgtatattttattggggatattagtaaggatgattgtttagtgattatttagtgattgagttatttggtgtttggagtttggtatttatagagtagggtgggggtagtaggttttgttgggggtataggtttgagaagggagtgttgttagttaggtttgatgggatagagagtgaagggttttttttttgaaggttatgtagaggttggaggttaatgttagtaattttattaatgttagttttttgagattgatttagagttggggttttaagagtagttttgggtgtttaggagttaagattttatagagggtgttttttatttttagtttagggaaagtgataaatttggagtgtttttgtttatggtttaattattgaatttaaatgaatgtattgataaattgtatttagtgttatttatagggaaaagggagggaaaaaaaaaaaagaaagagagttaattgtgtttaggttggttggttagggggaggatagatgggttattatttttgttattttttaggttttttgtattgattttttatttttagtaaaattaaggtttagtttttttttgtagttttggagttggttgggatgaagtaatttttgtaggtagattattaggtttattgtgatggttttagtagggaatttagtttaggttatagtagtttaggtgtttgtagaaggtttagatttttgggtgttaagttttttttttttgtatttgttttggggtttggtggggtgggtagtgtgtgatttttagggttgatgaaagagaggaggaagaggttgagtggtggtgagtttgaatagttaattttgggaggggttgaggtggggaaggtttttattgttgttttataggttttggagtaaggtttttatgattttattagtagttgggtaggtataggtttaggtgttgagtgtgttaggatttttgttgttttttgggtgggggtgagagggatttttatgggtttgtaattagatttgtgtttttttagttaattttttattaaataaatttatatgtatagtggattgggtatggttgttatttttgggagtttttttgggaaagttttttaaggttttgttgagttttgggaataggtttttatttgtttgggaattgggttggtatttaataaataaattaaagtttggtgttggaaggtagaattttgggattagagttttagttaagggttataagttttttaggaagttttttttttaaagagtggttgtgggatgttgggagtttttagggtggttagtttttaggtttttttaaagtttaggtggtattgatgttttgtgttaaggtgagggttgtagagaggggttggtggggaggagtttttatagtttattttggttattgattttatttttaagtattgaaataaagttttttttttatatttttggttagggagagagggtggaagttttaaatatttggggtgtatgggaaaggtttatatgtatagaagaattagataatggaagttgttggtggtggtgataggttttttaaaggggttttgagatttttgatattggtagggaagttatatattgtattaggtttgggggtagggagaaggggtttttaaggatggggttgtttttttttgtggaagtgttttgtattgtttgataagagtagtttggattagttgtggtataataggaagttgggagaatatggtggtttaggaggttggttagggttggggagtggttaatttagagattttggttgtttaagtgggtttagggtttttggggtgaaagtttttgtggagtatagtggatttagtgtttggaggatagattttaggtttagataaggttttttttttttttttttgagatagagttttatttttgttgtttagattggagtgtagtagtataattttagtttattgtaatttttattttttaggtttaagtgatttttttgttttagttttttgagtagttgttattataggtatgtgttattatgtttggattagttagtatttttagtagagatagggttttattatgttggttaggttggttttgaatttttgattttaggtgatttgtttgttttggttttttgaagtgttgggattataggtatgagttattgtgtttggttaataaggttatttttgatatggaatgttggtttgattatagtgtttgatggtttttgtttgtaattatgtttttgttttttattaaagtagggtttttagggtagaagttgtatttttttattttagagtgttttatgttattttttaggtgtatatagtgggttttttttattgtagttgaattggttttattattattataatgatagtttataggggtgggggttagtgggaatataaagtggttaatgtaatagtgttttagttattttgatatagaaatggttaggggatagaaggggtaagttgggagttagtagtaatttaggtttttagagatgagtattaaaaaaggtgagttatattataggttttttttgattatattttagtttaaaagagatttaaggagaaataagaattttatttttttaataaggatttgtatattagatgttaagtaaatattttttttttttttttgaaaaggagtttttggggttgttgggggagttggttaaagagaatgatatttatggaaatatatgtggttttattaagttttaaggtaaggtggtaatgaatggaggaggaaaatttatagtattattagggaatggggtttttttttgttttttttttttttaatgggtttttttatgtgggatttaaattaaattttaattttattttgatttagtaggtgttgtttttatagttttgaatagatttgttagaaaattattgtttaatttgtttttgggtggtatatttttttttaggaaaggaattataaatttattttagatgagtagagagttgttttttaaatttttgattaaaatatagtagattttatatgaaaaagtaaagagagaggggttagggatgaagtgtagtaggttggaggttgagttagtttttagagttattgggatggtgttttaggagtagatggtattgtttataaagttttttgtttttttttgttttgaggttggggattattttgttggttgtatgatttagtttttggggtttttttagtatgaaaagattttttgaaagtaggtttgttagggagattttttagtttttgtttattgatatgtttttgtatggttgatatgtagtatgttattgtagagaagtaaagtatatgtagattagttttgttagtagtattttttttttttgttttttttaggaatgttttgtatatatttaatatatttaggaatttagagttgtgttgtagtagtagttttttggattttagtgttggtgttgtggggagttttggttatggtattttgagtattgagattatttttagtttttagttagttggtttttgggagtttagaggggtgataatttgagtggagtgattttagagaaagtggtggttaatttgaatttttttttggtttttttggaagttagggaaattttttgtgaaaaggaaatatgttttaagaagttttgggtagtaggagaatttagttatttagtttagttggttaaatatttataaagagatagttgtgattatataaagttttatttttttattttgaggttgaaaatttggtttttgtgtggagattgagttttttgttattttttttttggggattttgtttggttttgttggttttgggttggggtttagggatagtgtggtttttggtattgttattatggttattagggtttgttttgtggttgtgttatttgagagtttttgagttagtggtgtaaggttgggaagaataaaggagtaggatttattttagtagtggaatgttgggttgtgttggatgtgttgagagttgtggtttgtttattgggttatatggtttagagttgagtagaggattaaaggggttttgtggttgtggaataaggagttttttagagtgtggggtagaggtagggagggattttgattgtttgggaagggaggtttggtggggaattgttttaagggggtagggtgaggggagtaggaggagggggtaggtagagataggggtgtttagtggtaggtttggtgtagaagtaatttgaaggtatgggagggatgttaaggagttgttatatgttaaaggaaagtgatagggtttttgggaagagtgagggggagttgttaggaagaagagaggggaagaggtttttagggatttttggttatgttgtttttgtttttgtttttgtgtttgttagaggtggtgtttgtgaggagttttttttttttagttaggttttgaaattgatttggatattttttttttttgtgttttgtttgatatttttgttttttaggtgtttttttatttatttgtttagatattgttatagttgggtttttagggagtatggttagttattttagaaagttatttagatttgtagttagggttggaatatagttatttgggtttgttttttttattttaggtgtttgttggttgggattatggaagggagaaggagtaggagaggaggggtaggggatgggggtgtagtttattttgagttttttttttgagagtttttggatttagatttgatttagtttttgtttttttagtttttttagtttttgggggatttggttagtgagttagtttttttttttttttttttttgtaggtttgggatgtgttgggatttagaggggtataagtaagggggtttttagaggagggagttgatattataggggttgggtttggatgttgggatttgttagatttattttagtgttatgatttttgaatttaagtgagttatttttagtaggggtgtggttatttttatattaggagagagtgtttgggagtgggtttgttttgagggtttgttgggggttgggagggatttatttaaatggaaagaagtttttggtgatattttttgagggttaggggttgaattttggaagttatgtttttaggtagtttttatgggattttatgttgagtgttgattgggttttatatatttttattttttttattttgtatttttatatgtggttgggggtgattgaagttttggggtatttgttatattggttaaataggttagttatgtttagtggttttttagttagtagttattggtatttgatttgttgttttttattttttatggttaattttttttttaaggttttttggttttatggttttttttatttttatagtgaatggttgtggggagttgttgttattggtttttgggtgttaggttagagttgggggagtgtttgggagaagattgtatgtttggagtttttgtttttatttgaatgggagggaggttggtggtagattagagatttgggttttgagttaaatattgaaatttaaggttttgggtttgttatttaatatttgtggaatttgattttttttatttataaaatgggtattattaatattagttgttaaaattatagtaagatatatatgtttaggttaggaagtgtggttatttagaaaatatagttttttttttttttaagaagttaatttttttagtattgggagtgagaagagtttgttttttttattgtttgtagtttagtttagggtatttttattattggtttttaaagggtagttttagaaattgttgataaaggatgttagaaggaatttttttttggttaggtgttagggttaatagaaagttttgaggatgtagtttttattatgtttttgttttgtgggtttttttttttttgtgggtagaattttttttttttggtttttttttttgaatttttttttttttgtttttggttttaatttgttttttagttttttggttttttaggttttttttagggtttaagattttgtttttttttaagtttagttttttttttttttttgtttttggatttttgagttgggaggttagtattttgggtgttttgttgaggtggttgttttttttgtagtggttttttttgttgttattaaatgagggtttttagagtatagagaaggtatttttggtttggggttgtattttttatataaagtttttgttttttagtattttttaaagttttttattgtttagtatatatttagtatttaggtagagtagttttagagtttttttggttggtttttggtttaattttttagtagaaatggtatatgggttatagatgtaattttatattttttagtatttataataaaaaatgtaagaataagttaggtatagtggtttatgtttgttatattagtattttgggaggttgaggtgggtagattatttgaggttaggagtttaaaattagtttggttaatatggtaaaattttgtttttattaaaaatataaaaattagttaggtatggtagtagttatttgtaattttagttatttgggaggttgaggtaggagaattgtttaaatttgggaggtaaaggttgtagtgagttgagattgtgttattgtattttagtttgggtaatagtgtgagattttatatttaaaaaaaaaaagaaaagaaaagaaaaaggaaattattaaaaaatgtaagaataggtgatattaattttaatattatttatttaatagagtttaaaatattattaatttaatatgtaattaatgtaaaaatgatagatatttgatattttttttttttttttttgttaggattttgaaatttagagtgtattttatatatatggtatttttttatttggaattattatattttaggtgtttaaatggttttgtgtagttagtggttattatgttggatagtgtagtttggagagttttaatttttttttttttttttggttgttggggaatagagttttgttttgttatttaggttggagtgtaatggtgtgattttggtttattgtaatttttgttttttgagtttaagtaatttttttgttttagttttttaagtagttgggattataggtgtatattattatgtttggtggttattttttgtatttttagtagagatggggttttattatgttggttaggttggttttaaattatagattttaattgatttgtttgttttagttttttgaagtgttgagattatatgtgtgagttattatgtttatttttggatagttttaatttgattttaggataatattaggttattagagagttgttgatttggattatattatgatttgaattttttagattatttttggtattatgtttataagttatatttagaggataataggatatagtttggtgaaatatatagtggtattttttataagatattggtgaggttatagattttattattagtgttatttgtttggggatattttatttttagaaaatgtagagttttttttaagaaatgaatgtggttaggtgtgttggtttatatttgttattttagtattttgggaggttaaggtgagtatattgtttgaggttaggagtttaagattagtttgattaatatggtgaaatttagttattattaaaaatataaaaatttgttaggtgtggtagtgtgtgtttgtagttttagttatttaggaggttgaggtaggagaattgtttgaatttgggaggaggaggttgtggtgagttgagattatgttattgtattttagtttgggtgatagagtgagattttgttttaaaaaataaataaaaaaagaaatgaatgttttaggtatatgttaagtattttttagatgattttaaagatattaattattgtgattgatgatgatttttttttttttttgggtgtgtttgttttgtttttttagtttataggtgtttaggatttaaaggtagtttgttataggttatgggatttggttggtttaaaagggagagtgaggttattggaatttttttaggagtgagtttgaagtttggaatgttttttggtggagggttttgaagttaggaggtgatgtagatgtgggggttgagatattatttggggttatttgtaaagagggatatttaggtagtgattttaaggaaagagtaaggggaggagagggtggtatatttatgtttttttaatttttgtttgtttggaggtttatgtattttatatgttggtttttttgtatggatatttttttaataagtaatttattgtgtttatgtttatttattttaaagttatatagaattgtatttattaaaaatgaatttatggagatagaaagtattttggtggttgttaagggttggagagggtgaatggggagtgagttttttatggatatggggtttttttttggggtgatgaaaaagttttggtgttagatagtgttgatggttgtatgatattgtgaatgtatttagtgttattaatggtaaattttatgttttgtgtattttagtataataaaaaaatatatatttaaagtaatagaatttaatgtgtttttttttttttttgagttagtttgtttttttgttttatattttaaaattagaagggttttgagatatattataggtttttagggtaggttgaataattttttttttttaaattgtgttattttatgtggtaatagggattttgtagatgtaattgaagatgttgagatgaagagattatttaggtgggttttaaattataagtgttttttaagagggaggtaggttaggtgtgatggtttatggttgtaattttagtattttgggaggttgaggtaggtagattatttgaggttaggagtttaagattagtttggttaatatggtaaaattttgtttttattaaaaatataaaaattagttaggtgtagtagtatatgtttgtaattttagttatttgggaagttgaggtaggagaattgtttgaatttaggaggtggaggttgtagtgagttaagattgtgttattgtattttagtttgggtgattttgttttaaaaaaaaaaaagaggaaggtagagggagatttgattgtagagaaggaggaggttgtaggaggatggaggtagaggttggagggatgtagttgtaagttaaggaattttagtagagttttttatttaaagttggaagaggtaggaatggattttgttaatattttgattttagtttggtgagattgattggtttttgatttttagtattgtaaaggaaggagtttttgttgttttaagttattgagtttgtgataagtagttatagtggtaataggaagtgaatgtagtttttagtttatttttttgtttatagtaatataggtgtttttttgtgtagaattttgttaggtagttagtgagtgggataggatttttttttgtttttatttggggttttgtgttggattttttaaggttgttgtttttgagatagtgaattttttatatttatagagatttattttaaagttgagaaagtgttttttttaaggggtgttagaaagaaggttttaaggtgtttttgttatatgtttatttgtttgtgggtaatatttatagtttttttttgtgatttatttaatagaagggttataggggagggagtattattggttagtttattttatagtaaggttttattttggaagttataggggatagttgggatttttatttttaatttagttaattgggagaagagtttagaatagttttggaggttgatatttgttaggaagtgtggtgatatttatgtgttgttgaaatatatagtaatatagtagtagagaggaggggatgtggttttatagttttttttttatttatttagtatgtatgtatatatatatatatgtgtgtgtatatatgtattaatttttagtttttaggttttgtattttgtttttgttaagttttttggttattattaagttaggttgtgagtatagagtttagtttttttgttaatttttttttaatttattttgggtaatattttaatgggatgtagtagatgttttttattaaatgttaagagtaatatttttttttattttttgtgagttggtggttgtgtttttgtatgggggtgtggaggaaagggttggggagtaggaatgtggttttgagggttggtatgtatttgtagttgtgatgttttgaggtagtttatatttttatttatagattaattttgagaaggggttgggagtatttatagtttttgttatttttgggttggtaggttggggaaattttgagtagtttgagtgaaggttgtttttaggtaggtatggtgggatagaggggtttttgtatattttttgtgaggtagtgtagttgttgggttgttttagtatatttgggtgatatgttttttttttggtttttttttatttggtttgggagaatgtttaggatgttttaattttaaaaataagtaaattttttttttttgatttatttatttttttaaattgtgaattttttttttgtttgaatagtttaattttttaaagtaggtttatattatggtttttagttttttattgtttatttattttttagtttgagttatttggtgtttgtttgttttattattaatttagtttttgaaaaaatttttatggttagtatttagttttattttatttgattttgagggtagtgtttgatatgtattagttggtttttttttttttttttttttttttgtattttttagtgttggggtttagatagtttttaagggtttttttgttttttgatttagttttttggagtgattatatttttgttttagttttttagtttagttgtttttttatattttgttttaggttttttttttggaatattgtttgtttttagagatttaagtttttattttttatatttttttttttgatttttagtttttttattaaagttttattggttgtttttttttggtgttttaaattagtttttttttgtttagattttataaggttagtttttattttatgattgtttttttggattattgggattattttttattaatatttattttttattttgtttttttttgtttatgtagggttttgttggaggattttttttgttttattatttttttttttaaatagttttttaggtttttttgttaaagttgaaattttttttttgtatttgaggatttttgtaatttggttaatttatttttaagtttgaatttttatttttgtttaaggagtttatgttttttagttaggttttattgttttgtaaattttatttaaaattttttttggtaaatgttattatttttaggaagtttttttgatattttttattatatgtgatttttatttttagagttagattttgatttggagattttgatttttatttatttttgttttttttgagttttttaggttgtaggttttagtttatgtttgtgggtttttgtagtaggagggtttatttttatttttttaagaagtgtttgttttattttttgttaagttgtaattttttataagtaggtatttttaatatgtttttttatttttttttttttttttttttttttttgagatggagtttggttttgttgtttaggttggagtgtagtggtgtgattttagtttattgtaatttttattttttaggttttaagtgatttttttgttatagttttttttgtagttgggattataagtatgtgttgttatgttaagttaatttttttttgtatttttagtagagatagggttttattatgttggttaggttggttttaaatttttggtttgaagtgatttgttgattttagttttttaaagtgttgggattataggtgtgagttattgtatttagtttaatatgtttttttatattttttttgaaaagttattattatattaatagtgtgttttataaattgataataatttaaaatgtgatttattattaaaagtgtgattttatttttaaataatattgttggttgtggtttgtagttagttttattatttttgtgtgatgattattttgtagattagtaatggttttaggtttatatttaatttaattattttgtttttttaattttatttttttttgagttaatattaagtgtgttttagagttgtaaatttatggttgatataaaattaggatttttaatatttaatataaagtaattgggttttgtattggttttaatagtaattataaattatgtttgttttttgtattgggtatattgtatttagtttataatatgtgtttttgttttttttattttttttattaagatggtatataggtttaaatttgttttttgggagtaattgatttttttttggaagatgtgagtagtttttatattatatttaagaagatattgttataagattttatattttttattttagtttttaagggtttatttatttttttaaaaatttatttgttttgttataatatgtgtttttttttttttatttgtttttttaagatatagttttattttgttgtttagattggaatgtaatggtatgattttagtttattgtaatttttgttttgtgggtttaagtaatttttttgttttagttttttaagtagttgggattataggtgtgtattattatatttggttaatttttgtatttttagtagagatggggttttattatgttggttaggttggttttgaatttttgattttaggtgatttatttgttttggttttttgaagtgttgggattataggtgtgagttattgtatttggtttataatatgtgtttttatttttttttttttttttattaagatagtatatgggttttaagtttttttttttttttttttttttttaagattagttggttgggtgtagtggtttatgtttgtaattttattattttgggaggttgaggtaggtagattatgaggttaggagtttgagattagtttggttaatatagtgaaattttgtttttattaaaaatataaaaaattagttaggtgtggtggtgggtgtttgtaattttagttatttgggaggttgaggtaggggaattgtttgaatttgggaggtggaggttagagtgagttgagattgtgttattgtattttagtttaggtaatagtgtaagattttgatttaaaaaaaataaaataagtgggaagaggggagatagtggaataaggagtttaatttgtaattgattgtgaataattaattgagataatttattatttttggattagttatgggttttattttttatttgtttttttgagttatgttttttagtgaaattttatatgtatgtgattaaatttgtttttttttttattaatttattttgagtgagtttaatttatagatttttaaatattgaatttaagagggtagaggaaatgtattttttttttgttataaaaatattttatttttttattgtagtgttgtttgttttatttatagttggtaatttggattttgttttttaaagtttatgaaagtaggatagattgtttgtaggatgtttttgttataaaaggagggttaggtttggtaggaggaaagaaatggaagtggtaaatgtttattttttgtgttagatagaggtattaggtgtttattgttttggggagtaaatatttttaaaaatggaaagaaaaatttttagttttattggggtgtaaaaagttatgattttttttgtggttaaatggttgggtggtttgggagataagtggtagttattttgaagtttagtttatttgtttgtaaatggagggtaatgaaattatttgttgtatgggtgtttgataggttgttgtttaaattttttgtttttttttatggggttttggggaagattatatgagttagtaatataaaagtattttgaaaattatatgaagtgtttaagtatgggggtgttggttgattttaggtttgtttttataagttggtagaaaattttttagagagggttttgtttttttttttggggtaggggttgtagtgttagatttgatggtattggtggttgtttaggttatttggtatgagattgttgttagttttagatttattttaagtttgggagggaagtaggttggggtgggggttttgaaattttttatatttttggtagagatattagggtaggtaaaagtgttatttatggtaaattaagaagtttgtttgaattgggtttaaattagtttagtttagaatggaggttagttttattttttttttttagaattaggagtttagtatattagaggttgagaaaatgttggaatagtttttttatttgtttgtttagagatagggattttaagttatttttttttttagtttattttataaattttttgtgttagattttttttgtttaggagttataggttttatttgggagttatttagggttttaaggtttttattatttagttgtttattttattaggttaggtttgtaggtatggagattagtaggatgtggtttaaatttggttgtatgttgattagttgagtgattttgggtttattttttaatttttgggaggtaatgtttttttatttgtaaaaaggggaaagggtttagtgaggagagtgataagtaaaggagatggtatttgtgtagatggtattgtgtgggtgtttagtggatgattatgtgttatttttttgttttttttttttgtttttgtgggagtgtgggtagtagggagttaagaggaagggagtagttgtttgtttgggatgtaggttgttttgaattggaagagaaaaaggaataagtagtagttgtttattgataagttttatgtatttgtgttttaaaattttaaaggtgtatttgaaagattttttgggtaaatttttttttatagatatatgaaagttaggtgtagtggtttatgtttgtaattttaatattttgggaggtgaaggtaggtggattatttgaagttgggagtttgagattagtttggttaatttggtgaaattttatttttattaaaaatataaaaatttgttgggtgtggtggtgggtgtttataattttagttatttaggaggttgaggtaggagatttgtttgaatttgagaggtggaggttgtagtgagttaagattgtgttattgtattttagtttaggtgatggagtgagattttattttaaataaaaataaatttaaaaaaaaggtatatgaaaaaggtaaaatgttatgagtgttttgttgtaatgtgttagttataaatgggaattggaggattttttaagttatttttttttttattttttttttttttgtatatgtattaatagttttttgggtgttggtagtattaggggatttggggtgttttataggttttgtttgtttagattttagagttaaggaggagatataaaagttaaaatagggtggtaagtggaataaatggggattagatggggtaatttggtagtatttggtaaggttttttttaatgagtttttaaagaggtttagtttttaggggaaggaggtgttttaggtagtgggggtttgtagaggtgaaggtttagggtggggtttttagggaagttgtttaggatgtttgaaaggaggggagtaatttatgagtttggtgatagggttggttataaagtgttatgaagtattaattaggttgtttattagtttttaggatagaaagattatagtagttaaggtgtggggatttgtttatttgatttttatttagtttagaaaatgattgttttagggttataggtaatagtttaagttttgtaagttgttggttatagggtgtagttgtggtaaggtggggatgtttattagttaagttttttaggatttttgggttgttggatatgtttgtaggatgttatgggggtaggttagattaggggtatttttatttttttttttaggttttagtttttaggttagagtgttttttggtttttggggtttttagggttgtagatagatagggagaggtttgtgttatggtgggttatttggtttttgtaggaagtggttagaggttttagtatttggatatagtagttatttttttaatttttgttaatgttgttgttgtttggggtttattttttttaatttttttttttaattagggaggaaagtattttggagtaggaattgggttatttagtttgatattttagtatgattttgtatgattttgggttagttatttaatttttttgggtttttatttttttatttgtaaattaggtagataattttttaaagttttttttagttatagaattttaagtgttaaaataaaaaaaatttataaaaaggaaatatgtgtttagtttatatttttgtttttatttgttaaaaggggaaatggatttgttatggggttttttttttttaaatagatatgggagattttttttatgattgtagaattggagtagtttagaggagtttagaattttttagagtttgagatttataggggaatttattttaatttttttgggatagaagtattgttgtttaatggtatttaatttttattattgttgtagtaaatgattatatatttgtgatgttaaataatatagattagttttatattttattttattaggttatagggaaggtgtttatagggttgtgtatttttttgaggttgtaggggagattgtgtttttttgtattttttgtttatttgtattttttggtttgtggttttttttttttttttaagttttttttattgtattttttagatggtttattgtgtttttaaaaatttttgtgatgatagtgggtttgtgtggattatttaggattatttttttattttaagattagttgattagtgattttagttggttttgttatgttatttaatgtagttttaggtgttggggattaggatgtgtttaattttgggagttattattttgttaattttaagatataggttttggagggagatgaagggtaggattataggtttaggaggttgtttgtgtgggtttgaattttggttttattattaaggaattgggggagtatattatttgtaaaatgggggttggtggggaattagttttttggttgttagtgtagagtgaggtagtgtgtgtagtgtttggagtagttttgtgagtatttgttttttttttgttaaatttataagaattgattttggtttaatggtttttttaaatttttagttttttttggttataaggttaggagtatttttttgtagggttatttaagtttttagtttttttgaaagttttggtttatatgatgttggaagtagatgtgttgtgggttgtttatttatgtatggttattggagaggtttggatgatgttgtttttaatgggtgtatagtgtagggtagggttaggtattaataattagttatagttattagtgtaagtaaggggtttttattgttatttttggtttggggttagggagaagttttgggaggtatttgatttttttatagggagtggggttataggagaatgtatttgaaaggggttggggggtagtagaaagttttttttagaaattttatttttggtttgtgatagatgatttttttaggttattattggggtttatttgggtttttgtagtatggagtttggttattttagaaggatgattgggtaggttagggttattggtgatggtgatggtaggtttttttgaggtttttttattagaagtattaggaggttagagtagttgataagtttttatttggtttttgaggggtagaaggttttgagtagttttttgattttttgaggtttttttattttattgagagatttttgagagtattgagagttattttttggtttttttgtgagagagttggttatataaaggtagttatatatttagtaagatgaatttataatttttgagtttaggtttattttggtttttttatagggagtttttgggggtgtggggtgggggtgtagaagggaggggttggtgttttatttttgggaattaggttatgagttttggatttaggttaaattatagaggttttatttttttttaggttttttgttttttaattatttttgtatagggtattttttttttttttgtagggttttattggggtggggtgaggaggagttatagaattatagtagttgttatatgggggtgttaaggtagggatgttgatgttaattgaatgggtatgggaaggtagagtaggaggttggtgttttgggtttggttaggttgtgtgattttagggaatttattttattttttttggtttttagttttttttattgtaaattgagggagtgaggttaggtgatttgtataattgtgtgaatttgtgttttgtattttttatttattattttaaataatgtttttaaattttagttttttaatgttttggtatttttttgtttgagaaatatttatggttgttttttatgttgtgttttaaatataggtattttggtttttttttgggtgtttttattagggttagaatgggtagtttattttgtaggaatttttaaggatttttagttatttttaggatgggggttggttgtttggaagtggtttttgtttatttttgttgtagtttttattatgaggttagtgtagtaaaataggaggtgtaggtggttggggttaggggttaggttattttttttagtggggtaggagaggggtgagaaaagttggatattgattattttaggttgagggtttgtgtggaggagggggtttatggtaaaggaagtgggaggatgggaaggagtttttgttggatatttttattttgttggttttagttttgtttttgttttatttgtggggagaaagtgaggttttttgttttgttaaattttagtaatgaattttatatttattttattttttgtttattggaaattttttttttattttttggatttgttttgaatagttgggttgtagaagttggtggaatgaaatatgtagggtggtttagaggggattgtgttgaatagtgttgtgtttttgtttatttttttttttgaagataaggtttttttgtttttgttttttttttgggaaagttggagagggggttgaggaaatgggatttattattaatttttttgtgtatgttggtttttagtaggtatttttatattttttaattaggtttgtagggtggaaaggtagttgttgagtttaatttaatttttatttagttgtggaagttagtgtggatggtaaagtatttatgtataaatatatatatgaggttgaggttaagagaatatgtgtttagtttttttttggttttttagtaatgtttttatgttttagttttgttttaagttttaaatggtgtaaggtttttttaggtggaggaatggaagtttttaagaagtttgtgttttagggattatatagaggtagggtttaggagtaaaggtttttagattttgtagtgtggtgttggtaagtttgtgttgttgtatttatattgttttgggatgaaggtgatatgttgattttttttaggtggttgtaggatagttaggaggaggtgagatgttagttaaaggtagttatagataatagtattatggattattagaaatgttatttttgtgttaaagtgtttgttttttttagttgttttattttgtgttaatattttttgggagtgatatgtgtgagattgggttgtgttgatgagtgattattggtatttttagattatattaaggaggggttattttgttgttaattaggtgtagggtaggtggtattggggtatgatgatttgtttggtatggttgttttatttttttttttgtttgagtataggttggtaggtttagaggagaggaggaaatagagttattatggggggtgtgtttaggggtgagttattttaagaagttatagaattagggtatgggagatattgtttagttttgttattaatttgttgtgtgaagttggttaagttattgtatttttttgggttttaggttttgtaattagagggttggttgaagaggtaaatgatagtggttagggatgggggtattgaagttagattttttgtatttggattttttttttgttatgtttagagggaggtttgggtaggttatttaatatttttgggttgtgggttttttattggtgaaatgggaataataatagaattaattttatagtgttgttgggaggattaaaggggatatttattttaggtaaagagtttttaagatagtttggggtttttaggaagtttttgttattattattggatattattatttttgttatggttgttagggttttgtttagtattggtagtttgatgttggtagaggaagggtgaggtttttgtttttttgtagtgttttttttttttttttttttttagttatggtaataatagttgaagtttatttttagttttagtgattggttatttttttgaattaaggattgaaggttttaggtttgttatttaaggtttaggtgtaagaggggtgagttattggtttttgtttttattatatttaggtttttatatgtttttttaaataggtttttgttttatgtgtaagagaagatgttaatttttatgtttggggtgggggtgtttataaatgttttggatgtgagttttgatgggggttatggtgtaggttttgttagggtatttttaattataggggattatttgtagtttatagagggttttttgtaggttaatgggattttgttattttggttgttattttgtttagttatttggtaaggaaaataggttgtagatttagaggtagtatgggtttatatgttagtgagataatataataagggaaggatgtgtaggatgagggagttatggagattttattgtagttttagttatttattagtagattttgtgtggatgttgggtaggttattttattaatttttaggatgtttttgtaggttttgtgggtggatagggtgaatggaggtataaggagggtaagtttgataggggttggggttgggtttggagttagaattttagttagttttgttattgtattttagggtattttttgtagatagtaggttaaagtaaggttgtttagattaaaggggaaggggttttgttttttttattaagggttttttggagattttaatatagatttttagtttatagatattaaatttagggtttttgagaagtgagaaatgtgaaaaatgtatagaatagttgtagtttagtgtttttaatatgttagatttatataggtatatatagtgtttttgtagaggttagaaagttttgtgttgggaagttttttgattgggggaggttttatagtaagtttttttttttgtttatttattaatgggtggaaggttttaattaggattatatgggaagggttagtgggaggggtagagagggaaaatgaataggtaatattaagtgtttggggtggggggtgtaggggatatttaggaggggagggtaggggtgtattttttatttaatttatagggaatgggggtttgggaggtgtaggagaaggttttggtatttttatttttttttttttgtagatttatttatagtttgtttatgggtagttagatttagttataggttagatgtttgttttagttttatttttttggtttattgaaagtaagttaggatagtgagggggatgatgttgttatttttggtatggttatgttgggttttggggtgggtgggaatgtggttggggtgttattttttttggttgttataggtataaaagtttttttgtgttttagtgttatatgtgggttttttttttgttgttttaataggatggatatttaagtagattttgttggttggggggggtttttgtatttagttttattttgatttagtgaattttttttttgttttttggggtaggagttattaggttgggttttaggtaatggttagtgaaggggttgtatggaggggttttttaggtttataggaagggaggttttttttttttgtaatgtggttgtagtattttgtgattgagagggatattatggttggagatggtgggatggaggattttttatagtatttttgatgtttagaatattttattttgtataaaaaagttttaaatttttttgagggttgaagttatttagagttggggtttttgttttttaggttaaaagtattttgttggagtagttgagagtatagtgggaggggaggggtaggagggaatagttttgttatggtgataggggattttttgattttaagagggtttgtagatattattatttatttttagttttgaattgttttttgttaaggggttagaaatttttgggagggggattatagggggttttgtttatgagaatagtgattgtggttaggttatagtttataagttagtaattttgtttagttgttgtggtggtttttttttgatggtttttagaaaaagtgttttattttttgttattagtgttttgaaatttaagaatattttttaaatagtaattgtagtaaaagttaatgttgtgtgagtgttgtaggtattatttttagggttttatatattttttgtttagtttttataaaaattttattttatttttttttttgttttttttttttaatagtttagaaaatgagtatggaagggttaagttggtttgaggaggggttggtggaatagtttgagggtttagtttttaagaattttatattgtaaagggaatttttgggttagggagtagggtatagtttttatttttttatttttgtttttagtattaggtttgatatagatggggttttggttatgaataaatgaataagtgaatgagagtttgttgagggaagaaggtgatagggataagggagaaataaagtagttaatgttgttgtgatgatgatgatgttaatggtagtattgatatgtgggtttttgttatgttaggattgttttaagtattttgttttatgaatatttttgttttttattatgttttgagtggatatttttattagtttattttatagaggggaatatagttgagtgtattggttaaggttatgttgttaggaaaggttagagtttaggtagtatgtggttttttagttgggttttggtttatatggttttataggtagttttatgaaatatgtagagagagtatgtgaggggtttttttgttgttttttatttttagttggggtttattttttgttgaaatttttttaatttgtttttaagttttgttagttatgaaatatttttttgaatatttagtattatttttttatggttatttggttttatttttttatagggtaagttttgggtgaaaagtagaaaggatgaaaatttttgagagaggtgataatgtggtaatttttttttttttttttttttttttgagatagtattttatttttgttgtttaggttggaatgtagtggtatgattttggtttattgtaatttttattttttgggtttaagttatttttttgttttagttttttgaggagttgggagtataggtatgtgttattatattaggttaatttttgtgtttttttgtagagatggagttttgttatgttgtttaggttggttttaaatttgtgggtttaagtaatttgtttgttttagttttttgggattatagatgtgaattattgtgtttggttgaggtggtttttatataaagtagagaaaattatttttagtttaaaataaattaataagtattgagtgtttatgtagaaaaagattagaaggaaatgtgaatatgttaatagtgtttgtttggaggatgtaattattattgattattttttttatattttttaatttaattattttgttataagtaggtgtgatttttaaaattataaaagataaatgttggttttttgtttgtgttttgttttttgagatagggttttattttgttatttaggagttggagtatagtggtgtggttatagtttattgtagttttaaatttttaatttaagtaatttttttatttgagttttttgaggagttgggattataggtaagtgttattatttttagtatttttgttgtttagattggttttgaatgtttggttttaagtgatttttttattgtagttttttaaagttgggattataggtgtgagttattatgtttagtaaagattgttttttaattaggaagatagatgttttttagtattttttgtttttttttttttttttttttttgatatggagtattgttttgttgtttaggttggagtgtagtagtatagttttggtttattgtaatttttgttttttgggtttaagagatttttttgttttagtttttagagtagttgggattataagtgtgtattattatatttggttaatttttgtatttttagtagagatggggttttgttatgttgattagtttggttttgaatttttgattttaagggatttatttgttttggttttttaaagtgttgggattatatgtgtgagttattatttttggtttgttttttagtatttttaatttttgttttttggtattatttggttaagtagatgaaaagttttagtgagttgttagttggtattaggttggggttttttttaggtagttttaagtggttaggatttggttttttttttagagttgggtttagaaattaagattgggaatgtgtgatggttgttttgtgggtttttgttatgaggttatttttttggttttagtgattggttgttggttgtagggagtatgtgggtttagttagggtttgtgttaatatggttttgttttatttatggtttagtgggtttttttattttttgttgtatgataattttaggaaaaatgttaggagggagggagttgttgggggtgtgataggagagattttttagggatagatttgtaaaaattgttttaaagttttttttaaggatttttaaggtttttattgttttttattgataggttatggtttgggtagagaaagttggggatggagttggtggggggagggtggttagtatttgtaaggtaaggagatgagttgggagaataggggttgggagggtagttttaggttagtttttgtttttagaattattgttttttttttttggttataaagtgaggttggttagatataggtttattttataggttgggaggttgggtgtgaaagtattgtgtttgtatggggtattttatggtgaatattattagagttaatttttagggtttgttgttttatagggaagttagtgtaaggtgtttatggaatttagaagtatttaaaggatttgatagttatgagttgggaggatttagttttgtagtaggagaaagagaggtagagagataggttttgtaatatttgttttatttgttgtgttgttttgagtatagtttatttttttgtggttttgagttttagttttgaggtttttaagattttttgggtttttgtagtttaggatgtttatttgaaaattaggtttagttagtagggttttttttgttagtttattattggttagtttttgtttagtattttttagtttattatttttatttgtgtaaattttatattagtattttaagtttttttttttttaggaaggagattgtttttagatgtgttttttgtttttttttgattaaagtttagaaaataggaattagttttgtgttttttttttttattgaattgttggtttttttggatgttttttttgattttttgttaatatttttataatataattagtttttagtttttttttaaatgtaattggtgagtatgttgtagtttaggtggatggtgatgtttttattttgtaatttgtgagagttagtatattttttagttaggtgggttgtaggagttagttgtggtgagggtaggaggtttgtgtgttgatggtattggtattattaaaattatggttagattaaggttatggttaatgagtttttttatttgtaattttttttttattaaggtggttttagttttagttttggttttagttttggttttggttttaggagttgtagatatatttttaagtttttattttaggagtttggttttatatatattggaggatatggagttggggtataaatagttaagaataggtatatttgtaattaggagtagggggtggagggttgttgagatgtttttatttttattggttgttttttttgatggtttattatttattatatattgattgtataattagggttgtgatatgtttgttttttatattatattattaaatttttaaatttgtttttaatttatatatgatgaggtaaatttagagttaataatttgtttattagtttttgaatttatgggtggttttaatttttttttttttagtttttttgggtttatatgagtattgaggtataagggaattttattagttgggaagtgtgttttttttttgttgattttatagtttttttagtttgtgtttgaagttgttaatatttttttatttagtattgttttttgtagtttgagttgttgttgtgtgatttagggttagtgttttaatttttttggattatatttgtaagatgaggatgttgttgtatagtttattttaaatggttattaagttgtttgtatagttaatatttgttgagtttgtgatatgattagttttgttttaattttgaatgtggtatttttatttagtttgggggtggaattgttagtttttttttttttggataaggaagttgaaaggttttagaaggtattaaggttagttgatttgttagtaggtatagtgtttatttgttatttatagtttttttttgattgttttgtttgtttttttagttgagattttgtgtgtatttgaatattttgttaatggttgaatttgtattagggttattgtgttagttgggtttgttaggttattgtttttgagttttgtttaaggtagggttagtgtttatattttgtttttttgttagtgttttatttaaggttttggaaaggttttggagttagagatttggttaaattttggtaatgttttatatttgttgtgtgattatgggttagtgatttagtttttttgtgttttttgggttgttgtgagggttataggagatgtatagagggttttgagtttggtggttggtatgttgtaaaggttagttatgtggtgtaaggatggtattgatgataataaatgaattgaatgaaaattaggttaattgggtttggggaggggtgttggttaaatagatttgagtggattaggattttgtatatgatgagtaagtgggaatagttttaaatagtaagttgggtaggtttaggatgatttagttttgggtgttgtttagggtttttttttggtttttttgttggtttggtttttttttgttttagtttgattgtttttatgggttttaataagtttttgattaggattgaggtagaatagatagggtttaagattttgtaggtaggtatagagtgtggatggtaaaaggagatgttttaggttttttgttgtttttttttttttgaaggttgataatgttaatttatagaagaagttgttttttttggttttggattttattttaatatagtgtatgaggtagttgtgtttaaggggtgtgattatttttgtagatggaatttatttattgtgtttagtttattgttagagtttggaggatgggggaagtgaggtggggtattttttatagtgaagggaaaatttagtttagttatttttttttgtgttgtttttggaatttattttgttatggttttattttaatttagttttttaaagttttagagagttttgtttttttttttgtattttattttgtttatttgtgttgggttagttttttagaagttttgttttttgttatttttagggtattaaggttggttggtgggtttagggatttttattttttgatttagttttagtggtttattttatatttattggtatttataggtgtgttttttatttttggtttttgtataggtggttttatattttgggagtttagttttttttaaggatttatgttagagtatagggatttttgtttttgatttttttttagttttaattatgagtagtttatgttatagtaattttttagttgtttgtagttgtttgttaagttatgataatggtttttgttttttaatttaatgtttgtatatagataaattgttatattttaagtagattagatattattttttttaggaagttttttttgattgttttagttggatagaggttttttttttttgtgtttttttaatgtttaataggtatttattgagtatttgtgatatgtaaggtatttataatataagttagtgttttttgtttttttagagggtatatgaataaataaatggtaagattttttaatatttatttatgttttatagaaagttatttataggtatgggagggttgttttaattgtgggtgatagggaggtttttttaagatggtagtgttttagtaagatttgaatgaggtggttaggaggtttagggagggattttttaggagggaataagtgaatatttttttgtgaggatgagtttttatgttttaggagtagttaggttaggggattggtgtagtgaataggggttgaggggagtggttaggtgatgtagggttttataggttgttttatgatgagttagtgttttaagtatagtagatatttagggaaggtttaggttggggagtgatttgaatagattttttatttaggagtttattggggtttttgggtttatgttgttgtgttattgtatgtttttgggggtttgggggggtattttttatattattattataggtagtatttttgggggaggtgtgttgtgtaggggatttgttggttattttgttgggtaaattataggggattgtgtaggataggtggttagtttaggagggataattatttaagtaggggttagagggtatttggatttgggaggagtgtttaattttttaggtttaggtaattagaggtggggggtggggtgttgttttttgatatgggaggtttgggggtttggttgtattttttggtgtggaggtgttgggaggtgtggaggtttttttttgaggttgggattttttggttattttgatttattgttttgattttattttttagtttgagggtatggtttgaatttatagttgtatatatttttttttgtatagggttttgtggggttggtatagtagttttttttttatagattaggatgtttagttttaggagggttgggattgtttaagattgtataattagggttagatatagttgggttaattttgtgatttttggttttatgtatagattttaagtatataggtaaaattttgttggttgggagggttggggggtagatgagtggggggtagtttttttttagttttttaatatgttaggtttttgggtgggagggggtataaagattttattttttttaagagatagagaaagaggtagtggagggtttttttttggttgaggttttaggttttgagtggtgaatgtaattttatttggaggttggaagttaggtggttttgggggtgtgtgaggtttgttagtttagttgtagttttttttatgtaagggaattttttttaggtagtgtttttatgattagagagggggttaggaagaggtgagggttgtatttagagtgatatttgggtgggttttattttggggatatggttatattttttttttggatttttgaagtttttaggtgtgggttaagggtttttagttgtaggtaggagagggttttatagttatagatttggggagtttagtttgtaaagtttagaggtttttggaggttgttggtttggttttttgtgtagttgggtttttttgggaggtttttttttggtatttttagtttttagtttgtatgattttttatagttgggtttatttttttaggtttgggttatatggtgtaggttagtggggttttgggggagggtagggtgttaggaatagttttgggggtggggggattggagtagagtttattttggttgtttgtttattttgtatgaaggatgttagatttttatatgtggttatttgattttgtttaattatgtgtaagttttggttatttttattttattgatgggaattaaattggttaaggagaagtttagaatttgagtagagtaggggtttaagttttttaggagttttaggtattttttagtttttttttttgagtattgagtttatatatttagtgtttggatgtttatttatttgggggtttggtgattgttagttagtatggtttataaagggtttttgtgtaataggttttatttgatttttttaaaaattttttgaggtaggataatgttatttaatttattttatagataaagtaattgagttataaaatggtttgttaaaagatatagaggtagaaagattaatagtaaagagtttttttgtgattttgattagtaaggtttttagaaaaaagtaagggattttgaggtttttataggaatagagttttggaggagaataagagtttagttttatgttatttttaaggggtattttgaaggttaaggtattgggtttaagtaggttggattgtgttttttgtattttttttattttttgaagtttttttttttttatttaggtgggttgtggaggtgtttataatatataatggaatagttggtaggttattgggttttttattgagttaaggggtttgattagaggtttaaatagtggtatagaaattatgagttttgttgtaaattagtttaggttttggagttaagtagttttgtgtttatagttagggttagttgtttttagttgtgtggtttgaggttagttttttaatttttttgtgttttggtgttttttttgtagtagtaataggaattgttttttatggtgatagtgtagatatattttatgaagtgtataaagttttgagtttagtgtttggagtatgttaggatgtagtaagtggttatttatgatttatgaaatattaataaggtgaggggtggaatgatagtttttttgtgttgtttttaaaatggaaataaatttgtttagtgtttaaagtagtagaaagtgagttaaggataggtttttagtgatatgttttggtagagtgttttttgttggttttaggtagggtttagggtgggtggttattttttagatgagtttattgttggtatttgtttttagagtatatgtttggattttttagatttttttttttttttttttgatttttttttattttgtaatttttattttttgttatttttttatttattttttttttttatttttgtttaaaaataaataatggaggttaaatgtgttagttggttttttggaaaggtttttttgtagtaggaatgtgatgggggtagtggaggattgtttagtgtaagttatgtgatttttgtgtggagttggggaaggggaggtgttgagattgagggtgttaggattgaggtattgagatggggttattggataatggttagggttagtttttgtttttattttaataggggtttttatatttaggggttatatttttaaagttttttggataagagagataaattttattatagggttagaaatgttgtttttaggttgttatttgggtgggggtgagagatgttttgttggtttttaaatatttattttgtggataaaattattaaggggaatttaatgtttttatagtagtttggttaagatataggtattaggttgggtgtagtggtttatgtttgtagttttagtattttgggaggttgaggtgggtggattgtttgaggttaggagtttgagattagtttggttaatatggtgaaattttatttttattaaaaatataaaaattagttaggtgtggtggtgtgagtttgtagttttagttatttaggaggttgagataggagaattgtttgaattttggaggtggaggttgttatgagtggatattatattattgtattttagtttggatgatagagtgagtaagatagttttaagaaaaaaaaagatgtaggtattgttttagggtttataagtataatttgatttttgatgttggtatttaattttgatgtagattttagtaggaaaagggagatgaattagaaggttgtggggatgaggggtttatagtagtgtttattagatttgttttggtaggtataagtgttttttggaggttgttagataagtagagggtttattttagagattttggttttggagggttgggttagggtttaggaagttgtattttggtagggaatttagagttattttgagttttattttggaagtaagagttagggggtagaatagaattggaattaaaagtttttgtgggtttagttttatggggatgggtttggttttatggggatggatttttgtattatttgaggtgattattagtttggttttttgggattagttttgagtgttttttggggaaagtgggatttgtagaggatggttttttaggatttgtttgattatttatttttagtttgtttttattttagtttttttgatttttattttttatttagaattttggagatttggttttggaggtttagagattagaaatgaggggagataaggggagaagtttttttttttatttgttggttatgttaatgggttgattttttaggaagttatattagttattgttattgttttggttgttttgtttggttttgaggttgggtgagtaagtattttgttttgtttgtttttttatttgagttttttgttgatgttatgagaggtttgattatgtgtttaggaggtataggatagagtttagagttgtttaagaatatataaggttgaggtttgggttttgtatttgggaagggttaggaagggttaaaggaaaattttagttgagtataatggtttatgtttggaattttagtattttggtaggttaaggtaggaggattatttaagtttaggagttggagtttagtttgggaaatatagtaagattttatttttataaaaaaaaattaaaattaaaaaattaattaggtatggtggtatatatttgtagttttagttatttggtaggttgagatgggaggattgttgagtttaggaggttgagattatagtgagtgggatattgggttattgaattttagtttgggtgatagagagagattgttttaaaaaaaatttttatattttatggagtttagtagaatttttggttagggtgttttgattgtgaaatgagtgtggtagttgttaatttttgagggtgaagatttatttattagtaatttgtattttggtatggtgagaggaagtgtttggggaaagatgttggttgaggtagagagtttagtttaatttattgtggaggagttattttagttttaaagagaaagattaataaattttaggtgaatggtttaaaagttatttttgtatatgtagagggtgtattttgggatatgtggatatttttttttaggataggaagtaaaattagtaggtagagatgtgagtttttttgtttttgttggagttaatttggagtttttattttggtttttagggaagtatagatttttatttttattgtagttaaaagattttttgttgatttttttagtagtatttagtttagttttgtggggagaggtggtagggggaggagatagagaaagatgagtttttggtagttgtgattggggggagagaaatgtggttttaatttgtttttgtttattttatagatgggtggtgttttattttaaaatttagggtagttgagggattgaaggaagagggggatattttttaattggggtttttttttattttattttatggtgttttatataggaaagagttggaaggttttgggtttttggtatttagttaaagttttaggtaggggtttagatattgggttgtgttattattttaggtagtttgggagttagtgatggtagagttttatttttattttgattattgtatagtattttgtttttaggatagtttagtagttaggttgttttagggtttaaatttagatatttaattgtgggggttttaggtaagtggttgaagttttttgtgttttgattttttaatttggaaaatgggatgatgaaagtaattgttgggtagggtaaggggtaagtgaaagttagtgtttgagagtgatgtggttaggattgttgttgtgattatatattgagttttttttttttatttgagataagggttttattgattgttgttagaaagatttagatttagaaggattaggaaagttgttttatttataattttagagggaaggggaggtttttgtgttagttggttgttgtaggggagagggtgggagatagatgggggatagaggagtaggggtagtaggaggaatggttggtagggaagtttgtttgagatttaaaggattgtttattaggaggatagtttaggttttttttattgagaaagatttttttggatagttgggttgaggatttttaggttttttgggtggagtagaattagttattattgaagttatataggtttgtaagtataagtgggggattgtttaggtatttttgttttataggggttaggtattaaggttagggtggttagaggatatgatgtagtttagtaggggttttgtagaattattagttaagaagatatatgtagaagtatgtaagtgttttgaggaggtaaattttttgttggattgaatatggggagttgagtttttaattattgagttgggttgtttggtttgtttttttttttttgaatagaaggtttttagatagagtagttaggtaatagtatggttaagtaggggtttgtattttagttttgttttgtagtttgattaggttgttgtttttttaggagatatgggattggttagggtttttttaggttgttataggaataaggtagggttgtgattttttttatggtttaggtatttgggggagggattatgagttttagtttaggggatagataggaaatggatagtttgttttttttttaattatggagttggttttttttttattgtattttttttagttatgttttttattagaagattattgtatttaatgggtggttttgtagtgatatttagtttaatgaagttatttggtgggggttttgggggatgtagttttttgaaatatatatgggtagtgggtgagttggaggttgtgtggggttttgttttttggggatggttaggaggtgttttaattatttgtaatttgagtttatagtgattgggatttgttgtttttttattttagtttttttttattagtatttgttaagtgttagttagtaggtgttggtatggtttaaggtaggtttgtagttagattagtattgggggagggattgggagagagatttttagagtggaagttatagttttttttttttttaggttgggtaatagattattatttttagttagttttggggaagggggaggggttagttgggttgtaggtatagtgttggggttttttgaggtggttgttgttgattatggttttttttttttttgggttgggtaatagattattatttttggtttattttagggaagtgggaggggttagttggggtataggtatagtgttggggtttttgtggtggttgttgttgattatgggtttgttattttttttttagttgggttgttattttggttttgaaagtgttttttttagtttttaatttgtgtttaggaggtagttgatattttaagtgttgttatagtaggaggttgggtttgtaagtgtgatttgtttggggaggggtagagggaaagattatttttgtttaaatagtggttttttttttttttttgggggtttttatagggtttttagtttttttttggttaagaggtaaggagaggtaggaaagttttaggaatattggtagagaagagatagggtaggttgttagaggaagtaggttgtagggtgtttaaggttttaggttgggttttgggaggttagggtatgggtaattaggaggtttaggtagggaaatttgttttgtagggattttgggagataggggagaggggatatgatagttgttttttgttgttttttggttgtggtttttaggggttttagtttagattagaagtattttatgtattgggttttggtttagtttggaagtatggtttatagatttatatgattatttgggtagtgatttttaaaaggttttttgttattagttggggagtttttgaggggagggtggttttgtagagtatttggagatattaatgggttgtgaggaaaggaggaggtgtggatatttttatggttttaagagaaaattaaggtagagttggaggttgggtgtggtggtttatatttgtaattttagtattttgggaagttgaggtgggtagattatttgaggttaggagtttaagattagtttggttaatatggtgaaaattggtttttgttaaaaatataaaaattagtttgttatggtgatatgtgtttgtagttttagttatttaggaggttgaggtaggagaattgtttgaatttaggaggtggagattgtagtgagttaagatggtattattgtattttagtttgggtaatagagtaaaattttattttaagaaaaaaaaagagtagagttggaggttaggtggtttttagagtttgataaggaggttgtggggttgggttgtttttttggttatttgaggggtagggattggtttagtttgagttttagatttataagaggttgaattggagtgggattttgagatgaggtagggttattttgtttatatttgtgtttaggttttaatagttattttttttaggaatttagtttgatggttttttaggttgagaggttgttaaggggttgtaaggtgttgtaatgtgtgagttggtgggttttgatgtgtgatagtttggggtattttttttattgttagggaataggaatgaggagttttttatttttagtgtttggtaggtaggaggttgttattggattgtgtgtttaggtgttattagattttgagggtttatggatatggtatatgatttttaatgattaatgtttgtgtagtaggtgttgaggtgttttaattttgagtaaggttgggtttttggaattttttttttggtaggaggatttgtagttgaggaatttttaagaaattttttggtagtaaataaagtatggggttggatggtggatttatgagtgtttttatatgaatgtggatatagatagaaaagatggtaaatatttgtgaataaaaggaatggtttttgtgtattgaatttttatttattggtttttgtttggtataaagtttttaggaattttttaatagttttagttagaaatgtgtttttgtttggttatgtggaaaattttatatatattaagatatatgatgtttttggttttttttatgaatgttttatgttttttgggtttatgatttggaatttgtagatttttgttgtttttgttttagagttataaggattttggatgtaggaaatattttttatgtgtaagggttttttttttttttgttagggtttattggtttttttttgtttataggtgttatttaaatttttgtatttgtggttttttttttttaattattttgtgtaatttgttaatagtttttttatttttagagtttggttgttggagatatataaggtatatagaatttgtgaaatgatattgagtatttattaggtatttattgtgtgttttgtttggtaataataagtaaaattataatgttttgggtatatgagtatatttttttatgtttatttttttagtaatttaatgagatggttttataaatggggaaattgaggatagggaggttagattggtttaaagttataggttaggaggggtagggttaaaatttaaatttagatagtttggtattaaattttagttttttatatgaaaggtattttgtaattttttgagaaggttgggattattatttttattgtatagatgaggaaattaagatgttaaatggttagatagttttggagttaggaggtgggtttagtggtttatgggagtatatggaatggagtttatgggaggtttgaggttgggattttgtattttattttggtttaagggatgaggtgattgggagtgttagagatattttgggattggttatttaggtgttttgtatttagttttagtgttgagtgggtgagggtggataatttgttatttagtagggttgttgtttgtattttggtggttttttaaagtttggttaagtaaagtaagattgtttttggattagagtgatttttaagttatataagtatttagttatgttttggaggatgtaggattgggaaggttttttttttattgtatttttatttagtttttttatggggtagttggttttaggtatagattagatgtttttttttttgtttgttgttggtatgtttttggttttattgttgttttagggaggggtttaagagttttttggttttgttatttattatattttgtttagagggttgggggtttagtattaatgttaagtatttagtagtaaaattatgggttggaaagagttatagtgttgttttgatttggttttattttatattgggtgttgtttttattagtttttttttgtttttggttttattttttaggtattataagttttgtaggtttaaagttaaatttattagtttttgattttttttagttgggattagggtgaggtttttgtttaggtgtaaaagttaaggtagtgttaaaaaatttaggaattaaataatattttgaagtaatattttaaataaattaaattttatgttgaataaattttgatagggttgtgtatgtgtagggttgggtttgttttaatttaaaattttaatatttgtttattatagagattattatgtattattttgatattgaaaaatattgtattaaatattatttgtgttgatttttgagttttttggtgtttttttatattttgtttttgataagtgtttgatatattttgttttagttggttttgttttttaggtgtttttttggggttgttttgtttatgttttttgtagttattaggagttattgagttattgtatttgttttattttgttttttatgtttttgtattgtttattttgttatgttttttttgtgtgttttggttgtatgttagttttagataggagtttggtgggttgggagtttatattaatgttgtttttttttggttttggtgttgggtatagggtagtattggagatttttttttttttttttttttttttttttttgagatatagttttattttgttatttaggttggagtgtagtggtgtaattttggtttattgtaatttttattttttaggtttaagttttgttttttggaattaagtagatttttttgttttagtttattgagtagttgggattataggtatatgttattatatttagttaatttttatatttttagtagagatggggttttgttatgttggttaggttggttttgaatttttgattttaggtgatttgtttgttttaattttttaaagtgttgggattataggtgtgaggtattatgtttggttgagattttttgaataaataaatattattggtatggagatttgtttagggaatttgtttagattttgttattgtatttttgtttgttgtgtttagaggtaatttagggttgttttagttgtttttatttggttattttttggtttttatttaggttggtttgttttattttgtgggttaagaaaatgatttagtgggtggtgattagtattttttttttaatttgaaaagaatatatttattagtggtggtagtaatttaatgttttttagttgatgaaggtaatatgtttgtttataatggaatggtttatgttatggtggaatattatttagggatgtattggtatttgttataatgtggatggattttggaaatatgatattaagtggagaagttagatataaaggttaaatgtgtaattttttgtataagaaatgtttagaattggttaggtgtagtagtttatgtttgtaattttagaattttgggaggttaaggtaggaggattatttgagtttaggagtttaagattagtttgggtaatatggtgaaattttatttttataaaaaatataaaaattagttgggtatggtggtataggtttgtagttttagttatttgggaggttatggtgggaggatggtttgagtttgggaggtggaggttgtagtgagtagagattgagttattgtattttagtttgggtgatagagtgagattttattttaaaaaaaaaaaaaaaaaaaaaaagaatttatatagataggaaggaaatatggaggaggagggtaggattgatagttaaaggttatggggtttttttttaagaaaaaaattttttaaattttttaaatttttaattttttaaaattggttgtggtgatgatggttgtattattttttgaatagattgaaaattatggaattatgtattttaaatgggtggattgggttatgtggtgatttatgtttgtaattttagtattttgggaggttgaggtgggtggattatttgaggttaggagtttgagattagttttaatatggagaaattttgtttttattaaaaatataaaattagttgggtgtagtggtatatgtttgtaattttagttatttgggaggttgaggtaggagaattggttgaatttaggaggtggaggttgtagttagttgagatggtgttattgtattttagtttaggtgataagagtgaaattttgttttaaaaaaataaataaataaataaattggtggattgtatagtagtttatttggattttaataaagttgtttaaaaaaaaatgaaaaaaagttttttttttttttaaaataaataaataaaaagaaaaaaagagagaggggaaaaaaaaaaaaaaaaagaaaatattgagtgtagtatatgtatggtaaaggtaagaattttattatggaaatttggttttattaatatattttatttttatttttattttatatataggtgtgttttggtttgtggtgttaattgtatgtttttttggaggttgtagtttagattggttttgaaagttgttttttgggtaattttaaattttttataatttttgaagtttttggtttgttgggattatttagttttttagatttagttttgttattatttatttaagattgtagttttggggaggggggtttttttttaagggtgtaggggttttgtggttttatttttttttagaatatatattattttgtattgtatatatgtgttttaatatggagtattttaggatgttggttatagttagttatgtttgtatattgattgattgattgtgttttgttgattaattatgttaattattgtgttgtatattgtttttattaagtgagttaaagtaatttttttggaataagttgatggattttaaataagttaaaagatatttttttaggaaaaaaatagtaatgaattttaagaagaaagaaaaatttttaaatttatagatttatggaaaaagtttaagtttttaaagtgttagatttttttaaaagtattaggtttagatggttttatgagtgaatttttgaaaagttttaatagagagattattatgttgttgtttaaaatgttttagaaggtagagggtaaaagaaatgtatttaaattgtttttgttaagttagtataatgtagatattaaaattgataaaaatagtatatatatatatatatatatatatatatatatatgttttatttgttttagattaagtttgttgttgtgtatttaagtaatattatttatttttattttgttgttgaaattaaaatatattttaatggatttatgattttaatatgtaaaaatgaaattatagaagtattagaagaaaatgtgggtgaaatttttttttataattttagaatgtaggagatttttaaataggatgtgaattttaaaagttaaaagggaaagtagagatttgataatattaggattaaaatgttttgtgtagaagaatattttagaaataaaattaaaagtaggtagttggggataagatatttgtatttgttgtgataaagatgtataaataatttttttttttttttagataggattttattttgttatttaggttggagtgtagtggtatgattatagtttatagtagttttaaatttttagatttaaatgatttttttatattagttttttgagtagttgggattataggtgtattattttatttagttaatttttgtagagatgtggttttgttatgttgtttaggttggttttgaatttttaagtttaagtaatttgtttattttagttttttaaagtgttgggattataggtgttagttattatgtttggtttataaagaattttttttaaaaaattttaataagaaaaggatatattttttaaatgaaaagagaatatagggttttggtttataatatatgaagagataattttttttgtttgattgagatgtataaaataaaatattaattggagagtatttggtttttagttaggggtaaggggtataggatttttttgttggattattattgtatagggtttagtagatagttgagtaggttgatgaggggaggggttttaaaaaattttagtaattattttagaggttaatttaggaataaggattaattttttttttttttttttttttttgatagggagttttgttttgttatttaggttggagtgtaatggtatgattttggtttattgtaatttttgtttgttgggtttaagtaagttttttgttttagttttttgagtaattgggattataggtataagttattatgtttagttaatttttgtatttttagtagagatggggttttattatgttggttaggttggttttgaatttttgattttaagtgattagtttgttttggttttttaaagtgttgggattataggtgtgagttattgtgtttagtagattaaaatttaaatgtatatatttttgatatagaaatttattaagagtttattttttagttatgtgtgtatatgtataagtgtgagaatatttgttgtagttttttaattatagtgggaagttggataagtttggtagggttatgggatagttgatgatataattattaaaaggaatgtgttattttgggaggttgaggtgggtggattttaaggttaggagtttaagagtagtttggttaatatggtgaaattttgtttttattaaaaatataaaaattagttaggtgtggtggtaagtatttgtgattttagttatttgggaggttgaggtaggagaattgtttgaaagtggaaggtgaaaggtggaggttatagtgagttatagtgagttgagattgtattattgtattttagtttgggttatgttttgttaaaaaaaaaaaaaaagaaaaagaaaaaggaatgtgttatatttataagtggtaatagtgttgttaaatggaaaaaataaaagttggtagtagaagtttgattttttttgtgtttttgaaaagtttatatttatatattgattttttttatataagttttgaatgattttgtaggaataaaatttaggagaatgttatatttagttgttaatatggttattttttgggagagagttggggaatgggagagaaaaatttttttttaaattttatgtgatttttattttttatttaagaatgattgggtattgttttttttttttttttttagatgggagttttgttttgttgtttaggttggattgtattggtataattttagtttattgtaatttttgttttttgggtttaagtgatttttttgttttagttttttaagtagttgggattataggtgtttgttattatgttttgttgtgtattgttttttaggatgaagaaagggaaaggttatagggagaatgggagttagaatatagagtagggtttttaaatattagtttgtgggtgagagagatatggggtgatattattggtttggaatttagggatggtatgaggtgttgtttaggggttttagataaggtttgtttgttgattaagtaagggttgtgttggtttttgtttatgtgtttgtttaatatgaattttttaggtgttttattttgttttatgaattattattgtttattttaattatgttgtataggaagaattgtgtttatttttataatgagaaaatggattagagaggaaagttattaggtagggtaggggtggtagtttaggtagtgtgagggtaaagttggtgtttttttgttatttttttatatatgagtgggtaaggtattataggagtttatattttaatttttgtgggttattttggaaggtggtagatggaattagtgatttttagggttatttttagttttaggttttagataggggttgtggagtggaattgagtttgatttaggtgtgttgatggtagttatgtaattgtggataaattatttttttttttatttgtattggatgagattgggaatttttattttgggttttttaagagttttggggttttatagagtatatttagtagtagtagtgggatggggggatagggttaggggagttttatgttttttttaattttaattagagtatttttattttaatttttttttgggtttagtgtttagagagaatgggaaggaagtttagttttggttatgggttattttagtttgttagttatagtttatattttaggagttttttttggattgaaggagatagagttatttataatatttatagaaaattttggagaggaagtggagtttaattgaggaagtgtttttttgtagtttttagaaatgaggttataggtgagatagtgtgttagggtggattatatggtatttttttaggttgtttgttggaatttagggtttggttaggggttgtttatattttgggttttgaggtggggagtttgagtgtgtttttttagggttgaatgtgttttttgtttatattgtatagagtatggttgtttggttgtggtgtgtttttttggataggtttgttattgtgtagatttttaattttggtagttgttttgggtttgggaggtggtgggtatagatatagttttttttttttttggtagttgttttgattttttgggataagtgttgagaggtggttttatttagtgttatgtgtttgggggttggggttttattttggggttaggttgggtggttagggttatagagttgtagggggtggagtagagaaattgtttttagtgtttgttttttggttttatttttttttgtagttgtgttttatttaaggtattttatagttgtttggtatttgttgtatttttggattagtttttttttttttttattattgtatggtgtttggtaggttggtgaggggaggggttttttttttgggttttggagttaggttttgttttttggttttattttgttttattatgaaggagatatattgggtttggttaatttttttgtattgatttttgtttttttagtatatgtgggattttttattttagatttaggtttgagaggttttagggatagtttggagaaggagggtatttgtttttagaaggggaaagagaaagagatttaattttaaagtaaaaggggatttgggtgttttttgtaagtagtttaggaaaatgggaggaggtgggagtagtgggattttttgagtaaggtattttggtaggaatgttagtgttttttggatatttttagaagtagaagtatatagttttatagaaaaattttgtaggtttaggatttgaggtatgatatgatttaaatttattgttttattagatattagtgagttttttgatgtttattaaggttttttgttttatatttggtattggatgaatttgtatattttgttttagggagtttatagtttagggataggtttagagtttatgtggggtgttttgtaaatatggggttagaagttgggttgtttatggggttttttttttttaaattatagtggttattttttttttaattttatagtttttgatttttattaggaatttttggggtttagtaggtgttttttttttgtaggttgatgtttgttttttttattttttatttaggtttagttttgattttattttttttaaagttatttttttattgttttgtgttgggtggttttagggagttttgtgttttgattaattttatatttaatgttgtattggtagttttgttgtttgtgttgagatttttttttgttttgtttttggaatatatggtttggtgtggattaagtatgtgaagagttatgtttattattattagtttgggggggtttgattttttgtttttttaatgttttatttatatgataaagatttttagattttttgggttataggaaaattattgagatatgttgttatgtttattttgttttaattttatatttatgtttataagtggttttagaattattgtggattttttttttggtttttggggtgggtggatatatgagagtttagtttttagttatttttgtagatgtttttttgatagattaagaaattgaggttgggaggggtggaatgatagtttagaattagttgatttatggggtagagttgggatatgtttagaattgagttgggtattgggtttggttttttttttgtttttagtgagtattttaagaaggtagagaattagatttatgaatgagtgttgagtatttgttttataaggtagttttggagaaatttggttggtgtggttgaggagttggaggggggtaattttggtggggggggttttgagttagtagttagtttttgtaggtttagtattgggtgttgtagtttagttttattttattttatttagaggtatttatgttggggggtaggaaaagagtagggatttaggagaggaggtaaggttgtttttatttagagtttgagaggattagggatgattttaaaggatgagtgtttttttgtgggaggatagtaaggagggtgttaagtttaggggtagggttagagttttggaaattgagaatttattttattagtataaagtttagattttattaggttttggggtggaggagtaggtagggatgtttttgttttttgtagtgttttttttttttttttttttttttaattatttaggtgtttatatttttttttgaaatgttgattttttttagaatttttatattgaagttaatatttatttattgagttttttagtataatttttagaggagagattaggtgttttgggggtaaagttgattaggaaagtttttgtttggtttttagggatgatttatgggggttattatatttgtttataagaattataaaaaagttattttaatttattattagtggtttatttttttagtataattttatggtatatttattatgtttaagttatttatttggtattttatgggattttttttttttttttttttttttttgagatagggttttattttgttttttaggttggagtgtagtggtataattttagtttattgtagttttaattttttatgtttaggtggtttttttattttaatttttttagtagttgggattataagtgtatgttattatgtttggttaattttttgtattttttgtaaagatagggtttttttatgttgtttaggttagttttaaatttttgggtttaagtaatttgtttgttttggtttttaaagtgttggatttataggtatgagttattgtatttggttttttatgggattttttataaaaattaagataggttgggtatggtggtatgattttagtattttgggaggttagggaagttgaggtgggtgggttatgaggttaggagtttgagattagtttggtttatatggtgaaattttgtttttattaaaaatataaaagttagttaggtgtggtagtttatgtttatagttttagttatttgggaggttgaggtagaagaattgtttgaatttgggaggtagaggttgtagtaagttgagattatgttattgtattttagtttgggtgatagagagagattttattttaaaaaataaaaaataaaaaaaaaatataaaaaaaaataaagataatagttttatttttagaatttagtgggggtatgaaaggaattttgaagattatatagtaaaattttaagtatggatattgttggtttataggtgaattttaggtttttttttatttttgtattttttgtattttaaagaaagggtatttgattattttttatgatttgaaaaattatttttatatttaaaaaaaaaagtttagtagaggaaagaaagtttatatataaattatttatattttaagttaaatatgaggtatttggattaggttttgagggatgtataggagtttattaaggtagtgatgtaaagagaagtagaggttagggtttaggaggttagggtaaaggggttgtgaggaaaggtgtgagagattaagggaagattaaagtaggagaagttgggaaggagagaggtgtgagttgagtaggagagtgaattaattgtggaggggtttatggtgagtgagtagagaaggtttagtatgggaagagattttagtagtgttgtgttttggggaagttagtttgggagtaatttagttggggttttaggagattttgttttgtatttatagttttggggtggagataaattatagtatagatgtttttttgtaggtagaagttaaggggttgggtgtttgtttagagggtatggaattttttttatgatttttttttttatggtgttagttggatttttggtgtttgggggatagaggggttgtagagattggttagagttgtgtatgttggggtttagggaatttttagtttagttttatatggaggggtagaaggggatgggtttgaaggaaagatgggtaggaagttgagttggagagaattggatttgtgtttagaatggttgtgatatagagagggaggatggagaagtaagtaggtggtgttttggaggaagaattagtggggtttaggtttgggttttttgagaagttatttttattggattttaagagtatttttttattgggaaggttttgtttttgtttgtttttgtattttttttatttggatttgtttaggtttttaggattgttagtttagtttatggatttttttatgtgagttggatttttatttgtataggtttttgtttgtgggtggttgggtttgggatgttgatggtttttttttatgttttggttttaatgtgtatattttattttatggagaaagttattgtttttttagagtgttaggtttttggtagttttgaatgttgttgtttttatgtggtttgttttttttttttttttttggtttgatgaaattgtatttttattgttggggaagttttttggatattttttgtgttttagttattttgtttatggtttggtgagttttagaaagtagagtttgtaggttgtgtttttgggtttggtttttggtatagtttttggtataatttaggggttaaattgtgtttgtttttggaggagaatgtttttgtatatttttatggatatttttttatttgttttttagagttaggattatgtttttgtgtatttagtattagttattattgagatttagatggtttggtgataattgtttttttagttatattttgtttgatttagttgagtgtgaatatattaatttaggatgggggtgtatttggtatgttaaataaaggttttgtattaatagaaggtaggggaggaaatagttttttgttattttgtaaattgtttatgtttttggtttgatattatgttattagtaattattgttattgagtttgggtggttggggtagggtggttttttagagttaagtttagagagatgggagagggaatatgggatttgtatattgagggttggaaaggattttttaaggtttattagtttttggttatttagtgtgttttgatgttttttttgtaggaaatgtagagttttaggttttagatttgttaagataaatgtgtattttatatgtttatgaaagtatgaggagtattggtttttttttaaatttatattttttttaggttttatatttttttagtttttaagtttattgattattggagaatttttatttaaaaagaaaaattaaaaaggggttgggtggtttatgtttataattttaatattttgggaggttgaggtaggaggtttatttgaatttaggagtttgagattagtttgggtaatttagtgagaatttgtttttataaaaaaaatttaaaaattagttaggtatggtggtgtgtaatttgtggttttaggtatttgggaggttgaggttggggaattatttgagtttagggggtagaggttgtagtaagtagtgattatattattgtatgttagtttggaggatagagtaagattttgttttaaaaaagttaaagaaaagttaaagaagatggaaagagggatttagagagatgtggaagtaatttaagggtttattgatggaggaatagttatataatataagtgtattgtataatagaatattatttagtttttgaaaggaaggaaattttgttttatgttatagtatgatggatgaatttttaggatgttatgttgagtgaaatgagttagatataaaatgggtagttattgtatttttttatatatataaggtttttagagtggttaaataaatttataataaagatagaaaatagaatggtggttgttagtagttgggggaggggtatggggagtttggtttaatggggatggagtttagtttgggaggatgaaaagggtattggagatggatagtggtggtagttgtgtaatattgtgaatgtattgaatgttgttgaaatgtatattgtaaagtggttaaaattgtatattgtatgttgtgtattttattatggttagaaataagaagtagtagttaaattaaaaatttagattgtgttgtttgtttaatttaaagaaggtttattgagtattattgagttttgattttgtgtttagaattagatttggtttttgaggggtttttaatttagttggtattttattatagttttatggagttatgatttttgttggggttagggggtatgtttttgagaagggatttaattatgttttatagtttggtatttttaaataggttttgtgttttataggattggtattaattttttgtttgtaagttttatgttagtatggttgtgggtttgagtttttttaggatgttgttggagttttatggtttttttttttttgttagaagggtatttttaaataaaattgtgtgtagttattatatagttttttggtttaggtatttttttttagtgttttgagaattttgttttgtaggttaaggtgttttttatgtttttttttttttgttataattattttttttgggggaggaggattagattatgggttttaatgtaagttttaggaggtatatgtttttttttttttttttaagtttttggtttttgttgggtatatttaggtagtttgtaattttttaagtaggagttattagaatgtgatagtttttttaggggttttaattttattttgttttatatttttgtatgagtttgttttggtttttgtgtggttttttattttttaagttttttaggttttttagggatatatagtagatagaggttttagtaaggtttatggtgatttataaaggaggttttttgaaatttagaaaatttttttaaatttttatttaagttttgtttggggtattttggtatgtttttattagatagagagagttattttttttgagtttgtagatttttatttttatgtattttggtttttttgggtttttagggtagtattttttattttatatttagtttttttttttaagattttgtggtaaagttagtaattaggttttttattattatagtatttaagatttagtgttttgtgatttatttttttggttttggggtgtagttttagttatagggggttggggtttgggttttagtttgttttgtagttgagatataggggtaggttttgaattttttaaggtttgggttgggttgggggtggtgggtgttttagtaggtttgggtatttggatttttatttttttgggggttgtgttggtggtaggggtagtgggtattttggggattttggaggtagggggttttattttttggtgggttgatttttggggtttgatgatggtgatttttgttttttgaggggttggttttggtgttttgtggtttaatattttggtttttttgagtttgaattgggatgggttgatggttttggtgttttttatttgtttggatgagatgttaatggatagtttagtgtgttgggatattggtttggttgttttggggtttgagagttttattttttgtagggatgttttgggggagtgttggtttagggagtttatatggtgggttgagggttttgagttttttatgtttaggttttggaatttttgggtggagttggttatagtggtttggagtaggggagtttggattttttggggtggggtggagttgggtgttttgatttttttgattttaaaagatttttttaaggttgaaaaataaagagaggggatgtaattggtgaatggatggttagggaatattttggtatgttttttgttaaggagtagtagaggaaggtaggtgatgtggtggtgagggttgggggtttttttttgttttttatgttttagtaagtggaagggatagttttattttaggagaattattatgagttttggggtagagatgtaggttggagtgggaagatgttgtttgttgtgttttgttatggttatggtgtaaattatatagtttttttttttagttatgtttatataggaatgttttagttttagagaagatttttatttttttttttttttttttgagatggagttttgttttgttgttttggttggagtgtagtggtattttttgggtttaagtgatttttttattttagtttttttagtagttgggattataggtatgggttattatgtttggttaatttttgtatttttagtagagatggggttttattatgttggttagtttggttttggatttttgattttaagtgatttatttgttttggttttttaaagtgttgggattataggtgtgtgttattgtgtttggttttgattttttttttgttgtggttgtttttatttttttttatttttagttaaggtatatattgggatattattagtaaatatatttttattattagttatagtgggggatatgtttttaataataagtgattgtaattgtaattaattagaattgtagtaggaataaaattttattaatgatattaagggtggatattggagtttttagtgttggtgaggtgttgggtttattgagtttattatatttgtagttgtttaattttgggatgtaaagaatattagtatttttagtatagatggggaaagtggggtatggggtagatatagagttagattgtatattaggttgatattagagtttaaggttttaattatttggttgtttggtttttttagtttagtttataggaattaatttttttagttattagttttttttgtatttttttatttattattataagtttgtgtagtgatgttaattattagtttttgttttgtagttattttgtttttttattagggtttgtttttttggaggtagtggggatggtatttgggaagttgttatttttatagtttttataattgtattttaaatgagagttagttgtttttggttattagggttagagtagggagggatttatatggtaggtatatttattagttttttttttaggttagatttatagtgtatttttgtggagatttatagtgtttttttagttgttttttgttttattaggttatagagtttgggttttatgggattttattattgttttttttgtttataggaaaagggatgatagttggtttttagtttttaataatagtgttttaggattaattttagtgttttttttttatttgtttttttttttttaaatgtatttaggtattggggaggggaagaggaagtttaattttttaattttggttgttttagttgttagttttttgggtaaggtatttttgtgggtgttttttttaagttataggtattttttttttttggtggatatagatgaaattttgggttattaagtttaatttttattagaagttgggtaaggagttgtgtggattttagagaatttttagttgttataggttttgttttagttttgttattgttttagaggatatgggtttggtgtggttagagttgtttattttttaagagagtagaaatttggatttttatatgatattttttgatttttaaatgttggtataaagtaaaataagttttttttaaaatattgagtagtttggttgatgtggtgaaattttatttttattaaaaataaaaaattagttgggtatggtgatatttgtttatagttttagttatttaggaggttgaggtaggagaattgtttgaatttgggaggtagaggttgtagagttgagattgtgttattgtatttagtttgattgatagagtgagattttgtttttataaattaaaattaaaaataaaataaaatattgtagggttaaataaaattaaatttataggttgtatttgtttatgggtttagttatgatttttagttgattatgtggttgtagggtagtaggatattgagttttagagttaggggtgtgttaggtgtgggtttttgatatggtgtttttttgtttttttgtattttgtatgtaaattgttggttgtgttttgattttgtagaagttttagggttttaaggaaaggttgaatgtttatttttattagttagaaagtttagggtttaatgtttagaattgaatgtaatgagatgggtttattaagtttattatatttatatttgtttaaatttgggttgtaaagaatattattattgtttttgtatagatggggaaagtgaagtatggggtagatatagagttagattgtatattgggttgatgttagaaagtgtagagtttaatgtttgggtttttgtgtggtttttagggttttttgtggttttttgatttgttttttgttttttgagtattgtttaaattgtttttatatggtgtgtttttgttttatgggtgttgtagagtaggggttggtttttaggtgtttttagtatttttttgtgtggttaagttggagaatagaaattagataggagaaggttttgttttaggtttaatttaagaaaataaatgattttttttgggagatttggtgaattttttttttgggagtttttttggagttatttttattatggttaatttatgattgaagatattgtattaaagtagaggttgttttggtgtgagtttatgattgagtttatggtgtggatgtaatgatttattttagttaggtttatgtgtataagtggattattttagaattggagttggttttttttttagggtattttttttttttttagttgtttgtgtggttggtgttttattattttggttatttgtgtaaaatgtatatgtgtgttggtttttaattattttttttttttttttaatgtttggtgtttttttatggatgggtttttttttttttattagttggtttttgtgtttattgtttggttttatgatttttttgggtgttttggtttagtattatttttatgtttattagtttttagtaagttttgagatagtaggggttgttttatttgtaggggttattttattattaggatggtgttgtttaaaggtgagtttgttttagataatagttaggagattttatagtttttagaattgtaagagaatataattgtgtgttagaagaatagtgagaataggaggtgttttattttggaggtgtttattttttttaggagatgttttattttgggggtgtttattttttttaaggaaattatgttttggttggaatgttaagaaggtgatatttaaatgaagaggtgtttattttggtttatgttatttttttaaatgagtatgttattgtttttttttttttttgggaattttttttaaagttaagtttattttagttttttttttggggagttggttttttatatagtttatattattttttttttatgttattttggttatgttatgattgttgagattggttatgaggggtgtgttttggttttttgggaatagagttgaatgttttttattttatgatattatgtttttattaggttttaggtgtttttagaaaatttattaagttaggtgtggtggtttatgtttgtaattttaatattttgggaagttaaggtggatagattgtttgagtttaggagtttaagataaatttgggtaatatggtaaagttttgattttattaaataatataaaaattggttaggggtggtggtatatgtttgtaattttagttatttgagaggttgaggtgagaggattatttgaggttaggagattaaggttgtagtgagttatgattatattattatattttagtttggatgatagagtgagattttgttttaaaaaaaaaaaataattaaaatttattaaatgttaggtgtggtggtttatgtttgtaattttagtattttgggaggttaaggtaggtttaaggtaggtggattatttgaggttaggagtttgaaattagtttggttaatatggtaaaattttgtttttattaaaaatataaaaaattagttaggtatgggggtgggtgtttgtaattttagttatttggaaggttgaggtagaagaattatttaaatttgggaggtagaggttgtagtgagtttagattgtgttatagtattttagtttgggtgataaagtaagattttattttaaaaaaaaggttggattataggattataggataggtataagttttgagggagtttttaaggaggagggatgtattagatttttatttttattttagtttgtgaagatttatttttgtttgaggttttgtagagggttgattagtgatttttaaaaagatatgtttaatatttaattttaagaatttatgaatgtgattttatttggaaaaagggtttttgtagatgtgattagggattttgggatgagattattttggatttgggatgggttttaaatttagtgtttggtgtttttataggagaaaggtagaaggggatttgggatataaagagatatggtggggagggttatgtgatgagagtagagattgtagatgttgttagagttaaggagtgtttgggttaatgtaagttggaggaggtaaggaagggttttttttttgagttgttggagggagtgtggttttgttaatattttgatgttaaatttgtggtttttagaattatgagtgaattaatttttgttgggttatttggtttttagtaatttgttttagtagttttaggatatttataatgagatttttgggaagatgaaatttttggttgtatagtggtttagggtgaggttagttggtgtggttatttattttttagtttagttttaattttattataattatatttgataaatggtttattgtgggttaatggatatgtggttattttagagttgttatattaggagtttagaggagtgagagttgtttttttttttttttttggagttgtataaaaattttagatggttggagaagttattggaggaattatattattttagatttttgttttattgttgggatatgtggtaatgaaataagattatttttgttagggatgttttatgggtaattgtttttttatggaggatattgtgagttgtatttagttgggaaatattaggagatgtttgttattaggttggtagaatagggttttttagtatttttttttttattagagttttaagattgtgttttgggttttgtagttatatatggttgtttttttttttttaatgtgtaggttttttgggaagttttttgttattatttttatagtggaattggtataatttgtttaggggtagtaggtttttgttattttatatgtttttattttttttgtggagggagatgtagttaaggggtatttatatttatttatagaagtgagagtgtttgtgagtttgttattttgtagattttagaattttgtatgtgattgtatagatttataggtttaattgggtagatttaaaggatttatgtagtagggaggagtattggatagtttttttttttgtttgtaaggagttaatgtaattgaaggatatagaagaggtttttagttgagtattataattgtggattgtgtatagtgttagaaagatgtggagttaggttatgttgggaggatttttatgttgttattggaaggtaaagtagtgttatttttttatttatagagtaggaggtttttatttttgttagttattttttttatttgtgaatttaagttttttaaagttagattttaattttgtaagtttttaaaagtttttttgggttttttttttaatttttattgattttaatttgttttaaaagtttgaagattgtttatgtgttttggtttatttttgggaatttattttaaggaaataattagaagtatagaaagatttatgtatgaggatatttgtattagtattaaattgataaaatttggaaatagtttgggtttttgtagattttttaaatttatatgttaaaggtttgtattattattaaaattatatttttgaagatgagaaatgttgagaatattaagtaaaaatagtaggatataagatgtatataaagattttaattttattttatatatatatgtgtagtttgtatgtatatatatatttatatttgggtagaaaataatgatttttggatggaatgaatggtggtgggtgttgtttattatatttttttgttttttgagatgtttatattatatggggattatttagtatgtttagggaataaaattattgatattgtttttttttttttttttttttgagatagttttgttttgttgtttagattggagtgtagtggtgtaattttggtttattgtaagttttattttttaggtttatgttatttttttgttttagttttttgagtagttgggattataggtgtttggttattatgtttggttaatttttttgtatttttagtagagatatgattttattgtgttagttaggatggttttaatttgttgattttatgatttgtttgttttggttttttaaagtgttgtgattataggtgtgagttattgtatttggttaatattgtttttaaaaaatatattttggtattggttgggtatggtggtttatatttataattttagtattttgggaatttgaggttagaggattgtttgagttaggagtttgagattagtttgggtaaatggtaagattttatgttggaaaaataaaattaaaaaaaaaaaaatatatatatatatagattttgatgttaataagttggagggtgtgggtaattgtatgttggtttatttttatttttatttttggaaaaatattttatagtttaggatgggtatagggttttttttatttttaagtatttatggttttagttgttatataaaaagaggttatagtgggttattttttagatgtaaatttttttttttaggtttatggtggggttgaaataggagtagtttggatttgggtttatttagagaggaatgtgttgtataagggattattgttaaggtttttgttttgattataggttgtttggtaaattgtttttagtttttgaaattagattaagtattttttggtgtatatattaggttttagtttggggagggaatattaagtgagttatagagttttgttttagtttgggataaatgttatgtaaagaaatggtagagtttaaggttagaataattttatgtgtagtttagtttttgtaggagggagtaatgtggtttttgtttagggtagggtggaattttaggtttaggttttaggaatgttagttttggttaaattgggttttttttgagtagtagtaaagtaggttttgtttttgaagaaatattggttatttaggagttagggttagggtttagggaagttggatagatggtgttaaggagtagggaagtatttttttgtatgttattttgagtttgtaggaaaaagttatgggaaaattttatttggtagataattttttataatttttaggatttatagagtgagtttagtagtatgtatgttatgggtatttttttgtttttatttttttgtgatattggattttggtataggtttttgatttgtgtagggtggggtgggtagttaggtagggttttggtgttggtagagtggggtttagttgtaaaggtttttttattttttatttatttaggatttgggggatgaggtttaaaggtttggtgtgtttttaaggagtttaaggattgttttagggttggagataggatgtatgggtttgtatagggattgtgttttttattttagggttgagagtaggagaattaaataggagagtgatataattatagtttattttgagttttagtgtttttagtgttatttgttgtaggaggtgatggggtaataaggtgtttttgaggttaggtgtggtggtttatgtttgtaattttaatattttgggaggttgaggtgggtggattatttgaggttaggagtttgagattagtttgattaaaatggagaaattttatttttattaaaaatataaaaatagttaggtgtggtggtgtatgtttgtaattttagttatttgggaggttgaggtagaatagtttgaatttaggaggtggaggttgtggtgagttgagattgtgttattgtattttattttgggtaataagagtgtaattttattttaaataaaaataaataaataaataaaaaataagattttttgggtgtaggtatggtatgtggtaggggtgattgttgttggtgtaattattattttttgggtgtgtgtttgtgggggttgtgtatgttgaaatgtgtggttattttgttggtgattaaggttgttttggttttattgttattaattatgtttattgattttatatggtttatttttgtgtttttatttagagttttttttagtgtttaagtttttggaaggttggaaggagtgagtagtgtagtttttggttaagaattgaagtataaaaattttagtttttttatttaattttaggtgggataaggttgggggtatggtttgtagtttttttatgttgtttggtatgggggttgggtagttatttgtggttataatgagttggtgaggtattttttattggttggattttttgtttggtttatttttatatttaggtattttttggtgtttttttttattgaaatttttgttttaggatttgtttttggagggatataaattagttttttagaattggtttgggttgtttggtggaggagggaggtggtttttggggtaggtggagtaggttttggatagggaggaggatatagttggggtgatggggaggggtgtgtttttaggaagtaaaattgtttaaaaggaaaggtttaaaaataggtgtagtgaagttgagtggagtttgtaaagggaagttaggaaatagtagtgttagtggagggtggtttttaggttttttatagagagttatatttgtttagggatagggataatgtgaatagaaggtaaagtttatattaaggtggaggaggtgttttttttttagagagttgtagttagatagtttaaatttgttaaaggtttgggagggaagaattagggtattattttatttttagtttaattttttttttagttttttttttttttgtttttttaaggttaggtttggttgggttatagtgttagtagttaagatttgtttttagtgttggtttagtttgtaggaggttagtttggtggttaaaggttattgattgtttaggtttatttgtatatgtggtttaatgattgaggtttgggatttggggttattatttatagtatttttggataaggaggaaaagaattatttttattaatttttggatggaggtgtagggagtgttaatagtatttttgaaaattttaaatgtattaggggggttagtatttagggaagagttataggaggttattttgatggattttgatgattatttttgtttaagtgttaggaggaggtttttttttttttgtttttggtaattttgggtttaagaagttttaggtattttggaggttttttttgtttattatagttttatttaagaggtttggtttattttgtaatgatgatgtgagaatgagtaggtttgtttagtgttagagtttgtggttggatttttggttgaggttaagagaaataaataagttttttttttttttttgtatgttataggaagagtagtttgttggttgtaaggggattttttattttgtttatggggtatagtagtttatagtattttttttagaaatggagtattggtaggtttgggtttttgtaagatggaatataaaggggtgggtagttgattttaatagttagtttttgggattttaaatttttttttattttttaattttgtgatgttaatttttttttggataaagttttttaataatttggtaagttagtattagttgaattagttttagtttgaattagtagttttttttagtttagttatagttttatttttttagaagggaaaagaagttttatggatttttttataaggaatttttagaatttgttatggtgtttgtaggggatattggtattaattttgggtttattaaatgtagtgggtttaatagtgttttttaaaatgatatgttttaagttttaatttttggaatttgtgaatatgattatatttggaaaatggatttttgtagatgtaattaaggtaagggttttaaggtgagattattttgaatttagtgggttttaaatttaatggtgagtatttttataaaagatagaaaaggagaaagatatatagatagggggagaaagttatgtggagataggggttagagattagagatgatggtgatgtgtttgtaggttaaggaatgttaggaatttttaggagttgttggaagttatgtttgtaagtttttaggttgtggtattttgttatagtaattttaggatatagattttaggaatagaatatagaaaagaaatgggaggaggtttagagtttgttgtggttattttagttattttatttgatttttttagtgttttgttaattttgaagttttttttagttattgagttattggttttgaaaaggagatatgggtgttttggagttggtttagtttggtaggaggtagttttgttttattgtttttttattagttattagtttatataggttttttatagtgggtaagtgtgttgttgttttagtttttgttggttttttttttgtttggttttattagttgtagagttttttgttgttgttttttttggtttaagaggtttatatatttagtttttttgggataaatttagtttatatttgttgttttattgtagttatttaagggttttttttattaatgtgttttttaagggatagtaagttatatggttgttttatttggggttagaattgtgttttattagagtaaggttttggagtaattatatttagggttagggagttatttgtttaagaatagaaatgtgtggttgggtgtggtggtttatgtttgtaattttagtattttgggaggtagaggtgggtagattatgaggttaggagattgagattattttggttaatatagtgaaattttgtttttattaaaaatataaaaaattagttgggtgtggtggtgggtgtttgtagttttagttatttgggaggttgaggtaggagaatggtgtgaatttgggaggtggagtttgtagtgagttgagattgtgttattgtattttagtttgggtgatagagtgagattttgttttaaaaaaaaaaaaaaaaagtgaaatgtgtagttttttttttttttatttttgaaatatgaaggggaggtgattgtaggttttttgggaaagatttttttattttttttttttttttttttttttaagatggagttttgttttgttgtttaggttgtggtgtagtggtgttatttttgtttattgtaagttttgttttttgggtttatgttatttttttgtttttgttttttgagtagttgggattatgggtgtttgtttgggatagttatgtagtagtttttgttttaagttatttttttttatgtagagtagaattaggattatagtaaaggttttagaggaggttattgtttatagggttttgggttttttttttgaaaggtagtttagtttttaagagggtaatagtgattgatttgggatgaaggtttttttgtgtttgtttttgttatttattgtgtgtttttggttttggtagttatagggttattttaggtggattttaaagtggtgttaagttgttggatttttttttttttttattaaattagttatgggaatgggagtatttttggtatatttttagatgtgttgtattggtttagtgttttttttatttttgggttttaaattagttgttggttgttttattaggagtagattgaggggaaatgggtggaagttgtaggggaagagatgtgaggtagataaagaggaagaattttttggttggggtggggttgttagggtttgggtgggagggttgtttattttttgtttttggtggaaggtagtagaagggtgggatggatttgtgtgggagggtttaggtgtggtttgtttgggggtaggagagggattagatgattttttaggtttttttgggttaaagattttttgataaatggttgttgttgaaggtaggagtgaggttttgggaggtgattgattttgaaaaattataggttgtagttttgagggttttaaaggttaagtatggagttttttaaaatgaggttttttttagttttaatttatttatgttttttaggtggttttagatattttgttagggtttttttggtagttttttgtttttgattttggagatagagaaatgtgatgttggtttttggtttgtttatagtttttttgtttttattatagggttgttagttatttttttagtttattgtgtgttttttttttttttttatttttgattttttaataatagtagatttttttttaaatatttttttgtttagattttgggttttatgtatgttgtttttagaaatgtattttagttttttgtgaggagttagtaaggttgtttggtgtttttttttatggatgggaagttttgttggggattaggatttggatttggagattttgaggagtgtgttggttagtgtttgttttgaggtttgggatagagttgttaggtataggtagtattggtgtgagggtttagttttttggataagtttttttttgtttgtttttagatttgttattgtatatataggtggtgattatttttgatttgtttgggtagagaagttatttttttttttttttttgttttattgtttattaggggaaatgttataagtatttaaaaaatgtaaaaaaaaaaaaaaaaaaaaaaaagtgtttaatattaggggttatttggtttaggtggagtttttattaattatggggttttttgtgttgtggttttaaggtgggtagttgatggtttttgtttgagttaatatgagttgtagtttaattataggggatggtgattttagggagtagagtttaggttttggttatagttgtatttaggagttagttgttttttagatttgtagagttaggggagaggtttggaggattggtattgaatgatatgatttaaagtgtgttaagttgggttggaggtgatggtagagttatagtggttatagagtttttatgtgaatttatatggatttgtttggtttaggttttgttgaattttagggtgaggaggatttggtttttatttttaaagatatgaagaggttgataaagaagagttataggtaaaagggggtggtgggtgtgttgtgtaggaggggttgtaattggatgtagaagattttagaaggggtaattagagagaggtagtatttttagaagatgggttgtttggttgttttaaatagtttagggtgtgattgaggggatttttggatttagttggggttttttttgttttgagataatgtattgggaaattttattaagtttatttaagaatttgaaaagttttttggaaatttagtgggtagggtgggtttttgggaggatttttggtatattgtgagagttagatatagtgagggggttttatatttttgtttagaagttttatggtagaggggtagaagtttagggaggagtaggtgttgagattagaggggtttataagagaggggtttggggtagggggtagttgttgagaagtttaggaaatggtgtttgtttttggggaagtgaagttttgggaatagggttggtgaaggggggtgggaagggggaggtgggggtggagggttaggttagattaggtattttttttagtagtagatttatgagtttttggaatttgtttatagaagtgataagtgttttgtttttagttttgtttatatatttatttattaagtgtggtagggatagttgttttttattatttattttgggatttggatttaagtggaggtttttggaggggtagatttaggggaaagggtttttttagaagtagttgttatttagaggatttgagatgagaattttattatgtttttattagatagaggagatttgtggtgtttttgagtttggttttttattttttatttagtagtgttttttttgtttattttaagtttagaatattttgttttttttaagattagttgttgtagtggattgaatagtgatttttaaaagatatgttagagttttagtttttggatttgtgaatgtgataggagttggaatagggtttttgtagatgtaataaaggattttaagaggagagtattttggatttagggtgggttttaaatgtaatgataagtatttttatgagatatagagatatagagaaaaggttatgtgaagatggagtagggagtggtgtgatgtatttatatgtttaggagtatttgggagttattagaagttgggagagaggtttgggttggagttttttgtagaggttttaaaggattagtttggttgatattttgattttggatttttggtttttagaattatttttagtttttaaagtttgtggggttttgttgtagtagttttagtaaattgttatgggggttttttttttttgttaagtttggtatttaaagttttttagttatttggggttaattatattgattttgggatttttaggttatttgtgtgttttatttttttgtttaatttttagtgtttgtgtggttatagttttttttttgtgatatgagttttttgggtttttgagtgtttatttgttttgtattgaaggttgaagttaaattttggagagaattgattttttttgtgggtagggtaggtattgtgtttttagtatagttagagggtattggttgaaatgtgtttttgtaaagtgttttttttatgtttgtattttttttttaagtggggaagttagagaggtttttttgattttttttttagttttttggggtaggaagtttgtggttatttgtttgtaaggattaggtggatagataattagttttttttaggttatattttattaatagagggttttttaattttgttggtggtttatgagagaaggaaaaattgaaggagttgtttatagtaaattttaaatttttgtgttagagaggtttatggttgagtaaggtatttttatttttattgttttgagttgttaatttagtttagtttagtattgtgatttttgatttgtttgtgggttatgggagtttggtttgttaattagtattttttagatatttattttgtgaagtttttagtggttgagtgtttttttgttttttttggatagtgtgggttataggggatattgggtaggaagatagttaagtttttattgtttagaaattgtttgggtttattgtagtaatagggatttatttattagtatgaggtttttttgtaggaggggtgggggtaggagggagtttgtggggtatagggttgtaggaggagttatttttttttttattaaattgtaggttttagttaagttatttttagtatggttgtttgtgtgggaagtttatagttgagggattgtttgtatgtggtatgtaggagttataagtgttatttatattttattttgggttaggtagatgatttttttggttttagttttttgatgaggaataggaagggttggattgaaagattttttttagtttggatatggaatgattttatgagggttatggtgaggtttgttttagttttgtatattagtttgggttagtagtttttaaaggtatagttgtaggggttttggagtagggataaggaggattagtttattttatttttttgggtagaggttaaggattttgtttttggtttatattttttgtggttaaaaatgtagaagtaagtagtgttggtagaggtatttagatttttgggtaaagtaggggttttatttgatattttaggtttggagtatgagaaaattagtttaggttttaggttttttgattgttagtgattagggaatgtgatattttttggtttttgtttttttattttttaattttagggggagattaggttgggtgatgtgtttttttttttgatagtaaatttttatttatttttatttttatttttgttttaagagggggttttttatggttgggtgtagtggtttatgtttgtaattttggaattttgggaggttgagatggatggattatttgaggataggagtttgagattagtttggttaatatggtgaaattttgtttttattaaaaaatatgtgagttggtaattttaagtttttagtagtttttgaatggaggttttttttttgtaggatttttaaattttataaatatgagtgtttgtaatttagttatttaggaggttgaggtatgagaattatttgaatttgggaggtagaggttgtagtgaattaagaatgtgttattgttattttagtttgggatatagtgaaattttgttaaaaaaaaaaaaaaaaaaaggtgggggtttttttatgttgtttaggttggttttaaatttttgggtttaaggaatttttttgttttagttttttagagtgttgggattatgggtatgagtttatgaattttaaaaaataatatttattgttttgtttttgattgtaaaaggaatttaggtataaagttgaaaatttgtaaaatgtataaaaataaagggaaaaaatttataaatttataatttaggtaatttttattaatattttgataaatgtttttttattttttattggggagtgtgtgtgtgtgtgtgtgtgtgtgtgtgtgtgtgtgtgtgtgtgtttaaataggtttatatagtgatgatgttgggtgtttttttttatgtggtgttatgtggttgaggtttttatatattttgggtttgtttttttgatttttttgtagttttgatgttttgattttagatatgttatttttggtttggattgtttaggagaattatttttggattttgttaaaaaatggattgttggtttttaatttttggtggttttggtttaggagggttgggtaagtttgggtattttggagtgtttttggggtgttgtaggtgtgaatttttgtttttttgaagatttataagttttattttttttatttttttttttttttttgagaattttataagaggaaagtttttatttggaggttgttagggatttggagttgttagtttatagttttattttgtttttatttttttgggagttatttaaggataatgtttagttttagttgttaagttttagttttagggttagttatatattgaaggatatgtagaagttgttgtgtgttgggtattgttgaggataaaggtttgaatgataagtgggaataaagttataaggttttaaaatttgtttgaggttttatagttagggttttggaaatttatgaaaaaagttagtttaatattttgttatggaatataggtaggagagggagtagtttttagttagtttttagttagttttttgttagtttttttgtgaattattttattttgggttatagttagggtagttgttgtttttttttttgtttgatagtttttgagggtaggagttagtttgtttattattgttttttttttattagggtttggtattttgtttggtatgtagtagaagtttaagaagggtttattgtgtttattttgtaatagttaatgtgtatgagtgtttattatatttgaagatagtgatttatttttgtttttattgtatagatgggaaattgaggtattgagaggttgatgatttttttatattgttgtgtgggtaagggtaaggttagatgtgagttggtatgttgggttattgtgttttttgtttatattttgttttgggtttgggaaggttatttttggagatttttatgatgttgatattttgtttagtttttttgtgtatttttttttatgttttttagttatttaaagtattagttaggtagtattgttattttggttttgtaaatttagttattgagtggaagagtagttaggttgaagtggggtagaggtagtttttgttagattttagggttgggatttttagttatttttattttttaaggattagtagatagagatttttattgtgtttagttaggggttagggaataggtttttatagtgggggagtgatggatggatgtaggtgtggattgggaggatttgggttggttttttagtgttggagttttagtagtttaatttattttgttgggtttttgtggggattaaaagatattttgtatataaagtattagtttagggtttggtatttaggaggtgtttaattaaaggaaatggttatgaaaaataataaggagaagtttagttataggaggtgtttgtgggtaaggagagaatagttggaagggtttggatttgggttagagataaagaatgtaagagggagggagggagagaaggagggagggagagaaagagggagggaaagaaagagggagggagagagggagggtagggtaggtaatagttggttttagggtagttgtgtgtaggagtttgttttattatttaaatattaggagagatgtaaatatttgagtgaggtttttttagtttggttttgttgtggttatagttagggttggagaaagagttttttttttattagggtttttgttttgtgttttttattttagttgttttaagattttatgtttttgggttaggagtaggggtttgagagtagtaattaggtagggtagtggggttagggagggattttgtttttgtttttattttttttttttgtttttgtttttatttttttttttttgtatagtattgggtttgtaaaggtgtgaatgaaggatttttttttttatttgattttaaggggtttaggtggttaagggttttttttgtagtttagaaaaaaaagtaaagtagttttttttgaggttttttggtggaggtttagggtttaaagtttgttgttataaatttgtagttttttttgtttttttaatagtgttttttttttatttgggttattttattattttggttttttttagttttttaggttttttggggaggaggatagatgtagagtttggattttgtgtgtagtagggtttttttaatgttgtggtgtattttgtttggttgtgggagtttgttttatgttatgatttgtgttggtattaatagtttttttttttattttttatttgagtgttgagggtagttgtgttaggtatagatatatagttttttatatatattatgagtttgtagaaatggtaagagaaggttgagtgtagtggtttatatttgtaattttagtattttgggaagttaaggtgggtggattatttgaggtaaggagtttgagattagtttggttaataggatgaaattttgtttttattaaaaatataaaaaattagttgggtgtggtggtgtgtgtttggagttttagttatttaggaggttgaggtaggagaattgtttgaatttaggaggtggaggatgtagtgagttgagattatgttattgtattgtagtttgggtaataagagtgaaattttgttttaaaaaaaaagaaagaaagaaaaagaaaaaaagaaaaggaaaatggtaagagaagttggttagtattatttgtttggtaaatttttattttggtttttggttaggaagtttttttttaggaagtttttttgttttatttttttttttgagtttatgtttagatttttagtgtttagaatagagttggtttttggggtatttatggatggttgttggataaataaataagttaattgttttttttatttttagtgatgtttttggtttggtagggtatttagtagtaatgttttttgagtggattttaaggagtattttttattgtgtagtttgtattagggattttagttttttattttaaattaaaggaaaaaatttaattttagtaaatatatagagtattttattttttgatttttaatggggggtaagaggtagaggatagaggagaagattatttttttaggtttggtttggagttaaaaagatttgtatgtttttattgtagataatattggtttttgggggatatagggtaggggtttggtttgttttttgtagggaaattgtttatttatgtggaaagtggggttaagggtttttgtttggaattagttttttgtatatggggtggggggtggggatagaaggagattttgtttggattgtatggaaatttattagattgttggttgttgatttggtaggagtagagttatttttattttttagggttttgtttgggggaggggagaggttaggtggttttgtttaggttatattttttatggttaggaatgttttttttttattagaaagaaagatgagataggtttattttgaattttttggatataggaagggggtttatttgtggtttaggtggtttttttttttatatttaaggggttttataaggaggtgttaggatttttaggttttgttttagggaattgttgtttgtaaaggttataggtagagatagttaggaatgttttttatgttattggttatgggttggaggttgtgaaattaggtatagaattagaaagatttgttataggttgtaaagggttttagagagttttagttttttagaggggtagtattgtagaaggggtgagaaggaaaaattagtttttaggaattgtttatttagagtttatataatatttaggtggtatgagataatggtttattttttattttatttttttgttgttttttaagatttgagtttttgggggtgtttttagtagatagggggatgtggggtaattgtttttttttaattgtatatttggaggtaatttatatttagatgatttttttgaggttgtgattagagtttggggtaggggaggggaagtgggtggatgggaaggtgagggagatttttttaggaaagttgttttaggtgtttgtaaggttttattgtttatatttaaggtataggtttttggttttgaggatataggaaatttgatgttatgtggggaggagggtattgtaatgtatttaaggttaggttttttgattttttggatattggataaatgatggtttttttagttggtttagagatgttaggagtgatagaatgttaaaggttgtagggggatatttagaaatttttgagaaagaagatggataaggaaaaataaaaaaatatgagaagtttagtagagtttgagttttgtatttttggttttttttatggttatgggtaattttttggagatttagttatgggagtagtggaggtaggtatgggtgggggggggggtgggttttattgtttatggttttggttgatattgaggttatttttttgtttttttaagtttttgggtattggtaggatttttaaaaatgataataaatttgaagtttttagaattgtttgttggtttagtttaaatggagttttggggttttgtagattaaattaaatagtttgagtttagaaatgttttaggtgtttgggggtgtttaggggttaattggtgggtttgtttggttggagagatgataaatttttttatttttgggattgtgttttagagagttttggattttttggttttataagtaatttagagtttttaaatttgggaaaaattaagagggttttggaaagaaaggtagtgtttgattatttttttttagtggttttgttaagggagagtataggaatttggtttttggttgggtttttgggatgaattaaaataaaaagaaaaagttgggggagggggtggtggaattgtttggggttttagtttaggttatatattaaggagattttagaggagtaggttagttttatttttggtatgatgatggatgggtatttggttggttggtaaagggaagagatggtaatagtgaggttttgaatttagtggttaagatttatttttgagtgtgattttttttgatgtttgggtatgtaagaaatgggaggtggagaaaggaggaggagattttagttttgtttttttggtattaggttattagggaatagtattttttttttaatgggtaggtagaggttataggttgttaggttgagaagtttttggtttttatagataaatgtatagtttgtatatttgtattattttgggtgatgtttattatgtatggttattatgtatgttttttattattaagatagttgatgagattaggtggttattgtgtattgggtattgtggtgattgtttgatattgatttttgggggtttaggtttttggtgggtttgtttttttaggtatttagttttttttttattttttgatattttgggtttagtgtaggggtatgggggtgtttagtggatgggtttatgggttgggtaagtagtatgtagttttggtttattagtttttggttttattattagataagatgagattgttttagttgttagtttagttttgtattatatttgattgggtttttgtagaggtttgttggatgagaatgtttagggtagtaggtattattttttgggatgtatattttgttataattgttttttagggaaaggttagtttgtagagttgaatgtaggttgttagtgtttttgttgtttttatggtttggttatttagtaagtgtttattttattgttagtgtttggttttgtagatgggtatatggtttatttatttgtgatattttagggtgggggtgggggtagatggtggtagggaagattaggataattttttagtaagaggaatttgtagttaatatgatgttagtttttagaatgttagttaggtaggaaaaggggggttttatggttgtattgggagtttgagtatttgttgggtttagagggatttttaggtgggtgttattggtattagtgtttgttgtgttttttataattagtggtgattatgttgtttggttttatttatatagtggtattatataggtttttgtttgagattttttatttttagatttgtatatttaagtatttaaatttatttgttttttgtaaatgttttttttttttgtttagatgttatattagttgtgatatttattatatttgtaggaggtaggatttgtgtttagtgttatgggttgtattttagagttttttagtaatttttaaagagagttgtttttaattttattttgtaggtagggaaataggtgaagaaattgaagaaattgaagttgtttagttttttaatggtagagtgagggtggtttgggtatttttatattgttatattttttatttttttaaagtattgtttttttggatgtaaattttgtttattagttttatttaaaatttttttggatagttatagtttatagaaagtatttttagtttgtagttatttagttattgtaggggtgttttggtgtttatttttatttgtttttttttggatatttagtttagagaatttatagttttgttgtaaggttgattatagtgtatttgttgtttgggtgttgtgtttgtttttttttaaatgaattaatttgtagttgggatagtgggtttgtttggttttgggttttgaatttaaagagtattaagttagtgttgttagtggttgtgggatttgtgtaagaggtttgtttttattttttatggtttttgttttttattataaaagtttaaattgtagagaggtagtatttataggatgttttgagttttggttgaaaggtagggtttattatgtaagaggtttattggtattaattagggataggtttgtatttattattaagtaatggggtttttttttttagagaggaaagaggtatttgaattttgttagtgtgttagtttttatgttttggaggtgttgggatttttagataagaaggtatatttatatggttttttttatttagaagtttgttttatagtttgttttgtttttagaatatagatttgggggttttttttgggtgatagtgggggtttgggagaagtttagatgttatatagttttgggatttgagtatgtgggttttgggttagattgttttaataaatattaaggatttttggatttttttttggtgtgtaaatttggttatagtaaatattgttgagtaaagtaggttaatagttggtatttggaaaggtttttgttatataaagatttgagttgtaattgtgtttgtgataatagatttggtttgaatttatgaaagtatatgttgtttgttagttttgtgtttttattaattagaagggagaaagaggaaagggttattttttttgttattttattatgggtagtggtgggtgttgtagttgtttggaggtttgtttgtatagtggaaaagtagaaaatgagattttaaaaattttattagttaaatataaaatattttttttgttgttatgtggtggtttttatagagttttaaaattttgaagtttggagatttattttgaagggggagtaaaggtgggatgtgggaagtttgagtttatggaagatattgatattttttttatttttgggaattttgagtttgaaggatttggtttgaatagtggaaggattgaatttttgtgtaatttattggtgatggaatataaagttatggtgtttttggtttttaagatgggagggatggggaaggttttgggtgaaggggataggtggggaaggaaaaggtgaagagaaaggtgttttttagggagggggtagatgtgtttaggatatgggatattggtagaattttaattttgagtatatatataggtttatggatggttttttgtttatttgttttttatgggtgtgttgtgttggtttgggtatttgtttttttttttatgttaggttatttgttgtttattttgtatattgttattagttttaagttttttagaatattttgattagggttttgtggtttttgttataggattttaggtttagatgtttgtttgattggaaaattgtttttagagatgttgtggtttagagtttgttttgttttggggtggtttttggagtttttgttttttagtaatttatatggtgataggtatttatatttgttggttttaggaattttggggttattattttagtgttgtaaggagttggtagttttttttttatttttttggtttattttgtaggaattaagatattaggtgagttgttttgggaaagagatttgtgtttttatggtgttgtttttgtgtttatttttagttattttagatgttttttgtggattagttgtatttttggtgggtatgtttggttttttgtagtttggtttatatgatttttataggtaggtttttttttatgttttagttttttttttagttagtttattttagttttttttattgttgttggttgttgttggttagaaggttttttttttttttgtaatttaatttttatttttttttaaggtttgttttttttatattgattttttttttgttagttagtggtgatttttttttattttgatttggaagttgtttgtttatattatttttggttgggttgaattatatttttttttttattttttttaattattttttttttatgtttgtttgtttatttaaggttgtttaatttttatatatatatttttatattttttaattatattttaggttttttgggtattagggagggttatttttttatattttaggttagtttttatgtatatgtgtatttatgtatatatatatttttttatgtttattgatttgggttatttgatggttttaagattagaatttttagtaaaattatttaggatatataagggggagattgataaatatagggaattagtagattgaggttttattttttgagattgagaaatttttttttagagttaaaggattgttaattgttgtattaggatggttttaatgagtttattgttttggattaaattatagggttataaaattggtttgggagatagttgtagaagtagttttagatggaggtatatgggggtaagggtggagttatatttagagatttaaggaaggggtattaataatttttatagtgtaaatggtgatagttgtataatgaatataattttaaattttggtttttttttttgttatagggtttttgttgagatatgagagtttttttttagaaattttattgggggtttgatattttttgttaggaattgagagtagagattttgattttgtaggtaggaggagagttttgtataatatagggtttttttttataagggtttattggaaagtggttagattggttaagttgtgttatttggatatttgggataaggaaggtttttggaggagtggttgtagggaggagttgtaaagaggtaggggtagggaggttatatttatttggggattgtaggaggtttaatggaatatagtggatttagggagattttagtatgagtatgtgtttaaagatgtttagatgaggaggtgttgtgggggaggggggtgggaatagtaagtttttttagttttgtagatttagattttttttttttttgggaagtagggatgtaaagggatagagtttgaaaaagggtttttattattaagttgataaagtaattatgatgtttttagtttatattttgtatagtgttagtggttattggattataatttttttttgtttttttgttgttttatattttttttaggtttagttttgaagaatagttattggtattttgtttggtgtttagttaaagttttggttttttaggaggttttgttttttttatttagatagggttgattttaggtgggttgtgtgggtagttgggtttaggatatttagatgttagttttggttttggttatggagtggggaggattttaggttggttattttttagtttggtttgatatttggatagtttgtttattttaatatagttttttttttttttggtttattagagggttttgtttaagttagtttaggagtttttttgaggggtgggggttttaggttttggtagaggtaggtttgttttttagaagttttgttttagagtgttggagattattgtgtgagttttttttttgtttgttgtatttatttttgtggatgtaggatgtagagttttagtattggtagttaagaggatgtaggaaagtgtatgtatttataggtttagagatgtggatgttagatttaggtttggatagagtagttttgtaagttttaatatattttgtaaattttgaagataggagagagttaaaatattttttttgtttgtatgtaggttttttttgttttttatggtttgattttgggaggtggatgaggatatttttaggtttggatgggggttatgggatattttattttagattttgttatgatttgggttgtgtttgtttggtgtttttggtttatgggttgtataatttggtggttttgaaattggtgtgggggaggggagggttgtttatttgagtaggatgtggttgtttatttagttggaggtgaggaatgatttttttattttgttgttgggtttaagtggggtttgagagttgttggggagagttaaagggaggggattgatggattttttagagtgaaattgtgtgttttggagagttttgaggtagttttgtgagtttttgaggaggttgttgttgtttggtaaatataaataataataaaaggaaggaaatttaggtggtagtgtgtagaatgagtatagggttttgtgagggtgtgtagggtttatgtgggtgtttttaatagggttttttatgtaggtggtgtgggtatggggttgggggtgtgtggtgtttttagtgggagggtgtttggattaggggttttgtttttttttagtgtatttttgtttttttttagtgtatttttgttttgtgttaggtttatttgtagggttttttttagtatgtttgtggttgtagtagttagtttagtatttatttttgaagtttgaaatgattttatttagttgtgtgttgattgtggggtttgatatgatggttggtgggtagtgggttgtgtggagggtagtggtgaggaagtgtttttggtggggtttgggttttgtgtgttggttggggtgttgtgtttgtgtttttgtagtgtagagttagttgttggaggagtttttaggttttttggtttagttgaatgaatgggggaggaaggtgggtgttggtttttttttgtgtgttgtgtttttgttttgtttttgttttttgggtggattaggtttttgtatttgtattggtttttttgttttgtattggttgttttgtttgtttgttaaggttaggtttggggggttggggtttgagtggttgttgggggatagttttgggtatatgattggagtgttttttttttttttgtttggtttgtgtttaggggatggtgagagatgtggttttagtttttttttttgggtgttttgttgtggttagatgtgggtggatgtggaggttgggttatggtgaggagggtgggtgtttagaggggaagagatttttttttttttttgggtgtagggtttttttgtaggaggttgtatttgggtagttaaataaagttttttgttattgttgttgtgtgttttgtgtttgtaagggttaaatggtagtgtatgtggttggtaggtaggattttggtttgtgggtttaagagttgaggggtgtagggtgaatatgtgagttttatggtattagtgagaggttattaatttttatttattgagggtatttttgtagttaatatttttattatgattattgttttgggggttattgttgtatttttttgggtgagttttggagaaggtattgtttgggagaaggggtatagggtggggatggaatatggttgttagagaagttagggatgggtgatgtttttttttttttataataagggttttttgagagtaggaagtagattttgttaggagtagatgtttttgaaggaaggtgtgaaggaaggagttaggtagtgagtgagtagaaagggagttgttttaagggttttttttttttttttgggttttaatttgaggtttagttttttttttaggttagtggtttttatttttaaattatattatttataaggtaggtagggttgaggggttggggtagatttggggatttgggttagatatagaatttgagaagtaataggtttttatttttaagaagggttttttaggtttgttatttataagagagagaggtgttttttttatttgttttggaaagttagaaatttatttttgtatgttttttttgttattttgttttttagatttttggtttttgtttagagttaggggttatgtgagaatttatagtatggaataatatttttatttttgaagtagtaggttgtaatgttataattgtattttggttttttgaatgtgtggttggggagtgtttgatagtttattttgggtttgaggttgtttgttgtttatttgtttttttttattttttttgaaatattttaaatgtgtaggagtgttgagattttttagttattttggagaggtggggggtagggggttttttgtggaaaatgttttaggtttgggtggttttttaagtagatgaaattaagttttttttttttaagaaaagtaggtatttttttttttatgttttggatattttgaattatttttaattaagtgagtttgtggatatgggaattgtaaaattatagatattttagatgtgtgtatatttttgttggtttgggagtttgggttttagaaatgtagttattgttgttattaatagtattttgtattttttatgttaggttagggtatgttttgtttgaattttagtatttgggtttattggatagtttagtttttattgggttatttgtttatgttgtatttggggatttgggggtttagtatttaagaaatttagtttaataatatagtttttttgggaagatgttgggtttggtataatagttattttaagttatagtattatttttgagtgtttttttaaaaagtatttggtgagtgtggatatatttatgtaattgtttttttttagggttggtatggagttttattagattagtatagggttagttaattgtatattttttatttttatgtatagtgtagtaaatatatttagttttttggggagtgttgttagggtgtatgttttattaaaatgggaatttaagggataatggtaggagagtagttagaaagtgtgtatgtttttgtgattgtgtttagagtttattggttttagttttagttattgtttttttaatgtaattatttagagttatatgattaggtttagaaatttttaggtaaggaggttttttgagtttttttaggaaatttaaattagggtttggttatatttttagttaggaagtttatttttgtatttaattaattgttttaattgtatattatttattttttttttttttttgtttttagaggagatgggaaatagttgggtattattttttaagttataattattttttttatatttaaggataatttagttgttttttggtttttttttttttagtttaaattatttttttttagttttttaattatattttgagttgttttttgattatagttaagggttgggtttagtttggggttttaggattttaatgaggttttattgttataggatagtgaggaggttttttattttttttttttagggttttagggtttggatatatagttttagaaggggtattgggtagagaagatgtatgttggtagtagagaggaaattgagttgaaatttggtaagaataaaagaattataaaggtttgtgtatttagtaaggtgtatttttttatggttataaaagaaggtaagattgattgtaggtttggttaaagggattgtttgtgtttttagtgtataatgagatttatagtgggttggtgattttttttaaaataaagatatgtttatttggaattttaaatgtgatttgattttgtttaagggtttttgtagaaagaatttaggtaaggattttaagataaggtgggttttaaatttaatgttgtgtttttttaagagatagaaaagaaagtatagagatatagaaaaaggttttgtgaagatagaggtagagattggagtgatgtagttataggttaaggaatatttggggttattagaagttggaagaggtaaagaaaggtttttttttggagtttttagaggaagttggttttgttggtattttgattttagatttttggtttttagaattgtgagaggatatattttttttgttataagttatttagttttgatagttgttatagtagttaggagaaatttgtgttttatttttatttgtattatgttttgaggttaaagttttatatagtaaagatgtttaagtaattataaattttgtgggtagtttatttgtttagtagattattgttttaagggaagggggatggggatagggaagagagttataggaaatttttgtatgtttttttggaaatgggaaggagtaggtttggagagaaattttataggttaggttttggggaaatgaagtttataaagtgtgggaatggagtggggaggaaatttatgaggaagtagtgtttggtgtatatatttatatttatgatttttttttaggtatagtttttatggagaggtttagttggtagggaagtaaaagaggtttggagagtgaaggaaggtgaggggtttttttttagtaatattgaggttttagatgggatattttattaggtggtaggttgtgtttttatagatagagattttttaagggtagggtttagatggttttatttttgtgtggtttgatataaagtaggttttttagagttgttgagttttgggtttgttagtggtagagttttttatagttttttaagtttttatagttttttattttaggaaatggtgttattatttatttagttgtttaagttaagtttttgggtattattgttgattttttttttttttttatttttagtatttaaattatggtgtgtttttatttttagtttttttgtgaattagtttgaattttttttttttagtagtgtgttagttaatggttaataattggttatttggggttagtaaaagtaataatatttagttttttgatttgtagtgtttgtttatttttgtggtgttaatatttttgttttggttaattttttttttttttttttttttttgatagggttttattttgttatttggtttggagtgtagtggggtaattttggtttattgtaaattttattttttaggtttaagtgatttttttgttttagttttttaagtagtttggattataggtatttgttattatttttggttaatttttgtatttttattagagatgaggatttattttgttggttaggttggttttgaatttagatgatttgtttgttttggttttttaaagtgttgggattataggtatgagttattgtgtttagttggttaattttaagttatttgtatgatattattggaggtgagattgagaagagatgtttagttattatgaatatagtgtttttattatataaatataattttaagaatataattgtaataggatagataatagttaaatgttgtaaaaaatttaagaggtgatgaaagttgtgtatttattattttttgttttaaatataattatttataagtaattttttaatgttttgtttaattttttttttataatttgtaatttaatttatattgtaaaaatttattatttttttaatagagtaatgtatttttattgtgataaaatatatgtaatataaaatttattatttttggttagttattatggtttatgtttgtaattttagtattttggaaggttaaggtgggtggattatttgaggttaggagtttaagattagtttggttaatatggtgaaattttgtttttattaaaaatataaaaattagttgggtgtggtggtaaatgtttataattttagttttttgggaggttgaggtatgagaattgtttgaatttgggaggtggaggttatagtgagttaagattatgttagtgtattttagtttgggtgatagagtgagattttgttttaaaaaaaaaaaaaataaaaataaaaaagataaatttattattttaattaagtttttatgttagtgatattaagtatatttatattgtatatttattaatattatttatttttgaaattttttttaattttttaaattgaaattttgtttttattaaataataattttttattttttttttttttagttgttggtaattgttattttaatttttttatgaatttgattttatataagtgaaattatataatatttgtttttgtgagataggtttatgtagtatgaggtttttaaggtttattatttaaggtttatatgtagtgatagaattttgttttttttgaaggttgaatgatattttattgtgtgtatatatattttgtatatttattttttttatatttgagtaattgagagtaaagttgttataaatatgggtgtgtaaatatttgtttaagtttttgtttttattattttattattattattttatttattattagtattattattattttagatagttttattttgttgtttgggttgtagtgtagtggtgtgattttggtttattgtaatttttgttttttagattggagtaatttttttgttttagttttttgagtagttgggattataggtatttgttattatgtttggttaatttttgtttttttagtagagatggggttttattgtgttggttagggtagttttgaatttttggttttaagtgatttattttttttagttttttaaagtgttgggattatagatgtgagttattgtgtttagttattattttagttttaaatattatagtaatttttttattgttttatgagattttttgagatagtggttttagggattttatatatatttgtttgattttgtgtaatgataaagtgtagttttttttgtagaatggtagagttgggagatttttgatggggtatgagtttaaaggggtagaggggatgtttagaatatatatggattttttatgtgtgttttgttagttattaagtagatttgttttagttttgatatgtttaggattatagatagtgtatggtttttatttgggttaagtttttggaattttttttttttttatattatttgtattgggagtagttattaggttgtggattattaagttttttttaggttatttgagtttgtatttttttatttagtttgattgagttggtgtgtagttattatattttattatattttttgtttggttgttttaatgtaattataaggttttatttaaagaagtatatgattaatttgttttttagattttttagtgatttttttagtttgttttgtgtagaatatttatagtaaaatttgattatagtggtttgagtttttatttttaaggtaggggattttttaaataaagtattagtgttttaaatttatgattttttaaggaggtttttggtttttagtatagtaaatgttttgttttatggttttttggttttttatttttattttatttgagttttttgttttggtatttgggattgaattagtttggagttttttagttttgttgtttgttggttttgatgatattattagggattgtagtattgtttggattttttgttgttatattttattgtaataatatttaatttgatggaattttgggagtaagtggtaggggtagggatggtggtggttaggggttgtatatatataggatagaaggattgaaggattgggtggaaagtatgatttttttaagatgatttttttttagtagaattttggttgtgttttttgaatagtatttgtttatttgtatatttggtgagttttgtgattagtaaatttagatgtttgggaggttattagtggttttgttgaggtataatttagatatgatagtttatgttttttttttgatttttttttttttatatagttttatgattagagtgttttttttatttttgtttttattttagttttgtaagatatagttgtgaaatggttaaagtttttaattttttagtatttgtttgagattggagtataaaaatgagatggggatatagtattttatggatattagtgatggaaaaaaattttttgatttttttgggagttttgtaaagttatattaggggataagaaggagtggttagtttggtattgatttagttttaaagtagttagtgattaaagtatatagttggtatttttttatttttagggtattaggaggtttggttagaatttatgttagttaggagaaataggttgtttttggggtttttggtgttttggtttttttattgtttttttgaagaaggtattttgttttgtggggtttgaggttggaggtaatttgttattgatgtagtgtagggatgagggttgagttattagtttgttttagttttatgttagtaggaataatagggatttaagtagagaagaaagtatttatttttaaagttattatagtgattgaggtgatgtggtttttagggagtttttttttttgttggttttttgtggattgtggttttatgttttaataatgtttttgtttattttgtaaggtttagtaggtggaaggaaagagggtggaggttgggagtggtggtttggtaatttgggaagggtagggagtaggaatatgtttttttttttttgtatttgtttagaaggttttatagggtttgttttgttatttataattttagggagatttttttttaatgtttgttttataaatgtttatttattttatatttgaatatttttagttatagggagtttagtatttatttatgttatttattttatttttggttgtttaaaaaagaggaaagagagagaaagaaaagataggaaagatagagaaagggggaaagagagagagaggaaagaaagaaagaggaaagaataagataggaaggaaagaaaaaggaagggaatggaagggaaggaagagagggaagaaagagagaaagagagagaaagaggtataaataaggtaggttttatggagtagagatttaataagggagtaaaatatatttgtagttaggttgtagatggatttttataggagtgtatatttattttattttttttggaatagaaaagtggaaagaagatgtagtggtgtgggtgggtggtggttttttttgggggtttggaatgtggggtattagtttttttggttttgagaaggagattaagattattaatatttatagtggagattgaattatataagggttggggatattgttttttttgtatttttaataaagatttgatgttttaattatgggaatttgtggaagaagaaataaaattggttttggggttttttagagaattggttttttatttagtggtggttgtgaagaaatttttggagttagttttagtggtttgggtttgtatagttgagattgtttttggaagttgagtggaagtggggagtttttaggtatagttgggttttgttttttattttagttagtagttttaggatttttgggtgttttagagttttttttagagggtaaatttagagtatgagggagtggggagatgtttaatattgggggatttttgtttgtttttgtttttagttttgttgatttgaatagggaggttatgggtgtttaggggtagaattgtgggttggtaagtttttagttttggtttttttttgtttttttttttttattgttattgattatttttggttatatgttgatatttttataggatgatggagaagagagaagaggaatttttttgttttgtttagtatattttaaagaggttttagtgtaaaggtattgatgtttatagttaaatgtgtgtgggggttttttaggagtgggatgtttttattttgttttagattgttatgaattgatagaaggttttatgttattaaatatattttattaataaattattttaatatttagtaaaaaaataaataaaaatgtatgtattttgtgttttgtagtgtttttatgttgtatttttttttgtatttgagttttggtttgtgtttttggtttgttgttttgggaatagaatgttttgtgtgggaggtagataggaagtgtggggtgtgttggttgggtttttttagataatttggtattgttttttttagataatgaaattttttttattttgagtgtttttggaagttagttggtagttagattaatttaaatgaattatttgttttttttgtgaagtgattttagggatttaatgggtttgttattaatatagttttttttgtattttgttttttttttttatttttttttttttgtatgagttattggttatgatgatttggtttagttaagggatttggttagttttggttaggttatgtgagagatagtataaaggattaaggttgttggaattaggttagaggttgagggttatatggattttttggagtgtttgtaattggggatttttaaggttgttttttggttttggggatttgtttatttggggatagttttaagggagatttttaaaagtagggagttaaaagggtgaattaatatagaaatattgagggttagggagaatttgaagatgggtttggttgggtatagtggtttatgtttgtaattttagtattttgggaggttaaggtgggtggattatttgaggttaggaatttgagattagtttggttaatatggtgaaatattatttttattaaaaatataaaaattagttgggtgtggtggtaggtgtttgtaattttagttatttaggaggttgaggtaggaggattgtttgaatgtaggaggtagaggtggtagtgagttaagattatattattgtattttagtttgggtaatagagtgagattttattttaaaaaaaaaaaaaaaaaaaaaaaaaagataggtttaaggtttggagagttagaagttatttttttatttttgggtggtttattttgagattgtattatgttagagaaagttgtgggagtgtttgtttataatttataagtaatattgttttttttttttattagtttttggttttagtaggtttttgatttgtgttttttttagggttttgggtttttttaagttggatttttggttgttggtgggatgattatgtgatttgttatttttttgtttattgttttgggtagtttttgttatttggtgtatatagagtggagtttagtaaggttggggttgttgattttttgttagttatatttgtttttttttatgttatttttttttgttttggttatgtttaggggtttatatttttttataagttaggtgttagatttttgtgtttgttttattttgttttttttgtttggtgggttttttatattttttttggtttgatttaggtttgatttgtttttaggttttagtttagaggttgttttttttaggaagtttttttgggattgttagatgaagggatttttttttggattttttttttatttttatagttttaggaatagtttttaatttaggttttattgagttagtgtggtatttaggagagttataagtgtgtgatgaatgtgttgaagtttttttaaaagttgaaggagttttgtgaatatatagtagtattagtttagattgtgaaggtataggggagttagttttttttagttttgtttgtttttggttttttttttgaggaggtgggagttagttagttgggattaggaggtgggttttatggagtagagatttaataagggaataaaataaattagagaatttttttgttgtaaggaatttagataaggagtatttagttagaggaggaaggaagagattggtagtagattttttttgttttagtagttttgtaagttagatgggttaattttttagtatagttgttttttagtatagagaaattttttatttttagtaatagggtgggaatatttttagatagggttatggttattttggttatagggattatggagtttgagtttttgtggtttgttttatttatgtggttatagattttgagtatatatttggagttatagagtttaaagggtagggtagggtagggaatttgtttgattggtgaaggttattttattatttggagtataggtttttgtttttaaatttatatggagtttttgatatggggtattgattttaaggaggtgaatgtggatatttaaggttagtgaatggttaggtgttaatatattgataggtttttggttttttttttaatattgagggtaggaaataaatggggtttatatggtgtatatggtttttagagttagtaaggtgtgtaagatttggtagttgagaaaattgattatttggttgggtgtggtggtttatgtttgtaattttagtattttgggaggttgaggtgggtggattatgaggttaagagattgagattattttggttaatatggtgaaattttgtttttattaaaaatataaaaaattagttggatgtggtggtaggtgtttgtagttttagttattttggaggttgaggtgggagaatggtgtgaatttgggaggtggagtttgtagtgagttgagatagtgttattgtattttagtttgggtgaaagagtgagattttattttaaaaaaaaaaagaaaagaaaagaaaagaaaattgattatttgattatgaataagttagaatatttatttagaaaaaaaaaatagttttgtttaattggggatttaaaattttaggatttatgttttttttttatagagttatattatttttttaatgtttatttttgattttatttgtttgttaagttttaggtatttagaatatagtatgatagtaagttttgtgatttttataggtttttttaatttattttaggtatagttatatttttagttttgagtagtagggagtgatatgtagatggttatttagatagagaaagatttttaaaaggagggtaggttttgttttgtaggtagtatttattgatatagatattagtaggtaaattttttaggaagatttttattaagaaagaatgaaagaggtttagtgtggtggtttatgtttgtaattttagtattttgggaggttaaggtgggtggattattttaggtaaggagtttgatattagtttggttaatgtggtgaaattttatttttattaaaaatataaaatttagttggatgtggtggtgggtatttgtaattttagttatttgggaggttgaggtaggagaattatttgattttaggaggtagaggttgtagtgagttaggattatattattgtattttagtttggggggtaatagagagagattttgttttaaaaaaaaaaaaaaaaaaaaaaaggatgaaagataaataaggttgaaattggtaggttggtatatttttaataatttattttaggttgggtgtagtggtataatgttagtattttgggaggttgaggagggtagattgtgaggttaggagattgagattattttggttaatatggtgaaattttgtttttattaaaaatataaaaaattagttgggtgtggtggtgggtgtttgtagttttagttattttggaagtttaggtaggagaatggtgtgaattagggaggtggagtttgtagtgagtggagattgtattattttatgttagtttgggtgatagagtgagattttgttttaaaaaaaaaaagaaataaaaaataaaaataataaaaaaaaaataatttattttagtagggagtaggaggtaaggtttgatatgtagtgtttgttaatttttgtggtgtaaatatatttattgtggtaaattttaagttataaataggatattattaaatatagagttgggaaaagatatgtatattattggataaaatgtttaggtagttatggtttatttttttttgggaaggggggtatgtttagaatgttttttattatggagaatgattgtggtaaatagggtttaattggtaggttgatttaattaattgtttattgatgtgatgtggggtaggtttttgaggttgtttttatgtttagggaagaaggtggttatgtggttatagatttggttttgggtttgttttttttttttttttttgagatagagttttgttttttttttttaggttggagtgtaatggtgtgattttggtttattgtaatttttgttttttgggtttaagtaatttttttgttttagttttttaagtagttgggattataggtgtttattattatgtttagttaattttgtatttgtagtatagatggggttgttggttaggttagttttaaatttttgattttaggtgatttatttattttggttttttaaagtgttaggattataggtatgagttattgtgtttatttgggtttgttattttgaggatatatttggagttatgtgtttatgattttttttttattttaaaattttgattttattttattgtttttagagataggttttgttttgttatttaggttggagtgtagtggtgtaattatagtttattgtagttttgaatttttaggtttaagtgatttttttattttagttttttgagtagttggggttgggtttataggtgttattatatttagttatattttatatttttttgtagagatagggttttgtaatttgtttaaattggttttaaatttttggttttaagtaatttttttatttttagttttataaagtgttgggattatagatgttagttagtgtatttagtagttattatgattgattggtgatgtttgttttagttttaggatgaaagagtagtagtattttagttaagtatttgtggtttttgattggaagatgttttttttgttttttaagtatagtgtaaatgttatttttttggtaagtttttttttaattttattttttttttggtatagggtttgttatagttttgtttatataaagagagttattagtgtatgtggtatagatgttagttgtttttttaatatttgagtttttttttttttatagtaattgaagttttggttgtgtatagggaagtttagttgaagaatatattgtttagtttttttgatgataggagtggttatataattgggttttggttagtgggaaggagttgaagtgtttaatttttaggttatgtttttaaaaataaagagggatatttgttttttttttttttttttttttttttttttttggttggagtgtagatatgatggtaggagttggaattattttagtttaagagatggaagttgtgtgttgaggatgtattaaaggaatgaattaggtttgggttgttttgggtttttataatgattgatatttggattgggatgtgggtttgagtgttgtttagtttttgatgttttagtttttgttatatagttagatggtgttttgattaatttaaggtatggttattattttatttgtttggtagggtaggggttttatttttatatgttgagtttttggtagaatttggtgtaatatatatagttaaagtaaaatgaataggttattttaattaaggtttattttgtgggttggttttggtatttggttttaatttttattttattttatttatttattatttttgagatagagttttatatttgttgtttagtttagagaggagtggtgtgattttggtttattgtaatttttattttttaggtttaagtgatttttgtgttttagtagttgggtagttgggttttttttgagtagttgggattataggtgtatgttattatgtttggttaatttttgtattttttgtagagatggggttttattatgttggttaggttggttttgaatttttgattttaagtgatttatttgttttggttttttaaagtgttgggattataggtatgagttattgtgtttagttagttttggtatttggaattggaaaataatagtttgagttttagaggggataaatataaatatgaggtagaaggaatagtaagtaaatatgtgtttagagtaggttgggttgtttatatttttaaaatattgttaggtgttgaggtttgggttttgtgttagatttttgggtgtagattttgtggggatatttattgggtagtgggatttttggtaagttatattatttttttgagtttttgttgattaagttgtttattgagaataatatttagattgaaaggatttataataatatgtgaaaagtgtttggtttaaaataggagtttggtaattggtagtttttattatttataatatatagtttaatgtttttgttttataggaatgaaaataggatttagataggtaaaatgatttgttgagggttgtatagtgttaatgatagagttaggattagggtttggggttttgattttttttgtagtattttggttttgtgagaagtggttttgggtgaatataaggagtgaggagttggtgagaaattttgaaaatgaagttgggtgtggtggtggatgtttgtggttttagttatttaggaggttgaggtaggaggattgtttgagtttgggagttggaggttgtagtgtgttatgattgtattattgtattttagtttaggtgatttagtaagattttattttagaaaaggaaaggaaaggagaggggaggggaagggagggaatttttgatagtgattttagagataattaggatgatttgaaattattttgaaatgtattaaaaaataaaaataaaatggatttatggttaggtgaaggagggatagatggatggtgaggtgataaagtaggtgtagtttggtgttagtggtagaatttaggtgatggttgaatgtgttttttgtaaaatgtttttaatttgattatgtgttttgaatatttttataatagaatggagggaagagaaaggtaagagggagttattgtagttgttgtagtaggagtagattttaaaatattatgtattagatttttagttttgtttttgtggatgtgtttttgtttttttttttgggatttaaggatatttaatgagtgtatgtgtttttaagtttttttgtttttttatttgtttttatatttggaagattttataggtggtgtgggttagttttttattttgttttttgtgtttttagtgtatgatagatattgagtgagtgttagtttttttttttgatattttgtttgtttgtttagagaggtttttttatagtttagttattaggttgatgtttttggatgtttggttgatagtttttttagttgtgttttagtgatttggtaggtgttttgagttataaataaggttattagtggatgtttttaaagttttttttattatggtgttttttttttttttattaatagtttgttatgatagttagtttgtatgagtttttttttagggttgtgttttttgaggttgtttagtgtttggtttgttagagtttattagatagggtgtttattttttttaggtttgagtttttatttagagaattatttatagaaggataatggagaaaggtagttggggtattaaatggagtgtgtttgtatgtggggggggaggggagggggagggaaagtaggaagagaagatataagaggagaaataagaataagaggaaatatagaaggaggaggagtagttttttttatgggggtggattttgtgtttagttttttattaaggatattatatttattattttgtttggtttttatgaatatttttaaggttgtttttttttggtttttatttttttattaggaagtggaggtatagagtgagaaagagttgtttaaggtttttaggtagtttatggagttattgggagttatatttaatttgtttaattttatgtttttgtttttagttattataataaattattaaggttttatagttataggagtttagtttggagtttttattgggttttttaaggtagggagatggggttggaggttatgttaggtgtatggtgtttagagttgtttaggaagttttgtggtgtgggttgggtattaggtagtgtttgtaggatggagaaatgaatgaggttgagatatagtgttgttttttttaaatgtgattttttttgagtttttgtgattggttatttgagagggtagttttggttttttggtgtttatgtttgggtttagagatgttttttttagttaggtttttttttgaggatggaaatttagaattttattataggaggaagagttgggagtattttattttttttttttttttgagatggagttttgttttgttgtttaggttggagtgtagtgatgtgattttggtttattgtaagttttgttttttgggtttatgttatttttttgttttagttttttgagtagttgggattataggtatttgttattatgtttggttaattttttgtatttttagtagagatggggttttattgtgttagttaggatggttttgattttttgattttgtgatttgtttattttggttttttaaagtgttgggattataggtgtgagttattgtgtttggttagggagtatttttaagatttttgtggagggttgtttaggtttaagttttttattatggaaggttttttagatgtggtagttatggtgtatgggttgagggtttttatttattaagaagtaggagtatttgatgtatatttagtttatgatttttatttatttgggggttgtgtttgtagttatgtgatataagggaatagttatagtagtgggttataaagagagtgtgggttaatgtgtaggggtagaattttgatagttttttatgggttggtagtagggaggggtatatttgtataaattttatatgtatagttttttatatatatgtggttgataattatttatatatttaagatgggatttggtgtatagtttattagtaataggtgttggtaatttttagttgtttttttgttgtggtgtagatattatttaaggtgggatggagagagttattgtttttaaggttatatattttaaagggagatgttgggttatggaatgaaaataggaggattagttagagttattggttttgagttatataatgggatatataggtttatttattttatatttttattgagtaattataatgagttaagttgtatagattatttaaataattggtatgtagaaaagtattttaatttttttttggttttgatgtgatgggaagaatttggatttttggagttatagagttggatggaaattttggtttagttaattattggttgggggagtttgggtaagtgatttaaggtttttgagtttgtttttttgtaaaagagtagtgtttgggtttgttatgttaggttagggtaagatgattgaagagtaagtgtttagtattggttaggggttaatgtttttaaggatgtaaagtgtaataagtaggtgttatgattgtattgttttttattgtttgtggtaaatatataagtaaagatggttttgtgtttgtgttgggggaggtagggaattggttttaggaggatgttggtttttttagttgttttttttaaagttttttgggaggagaaatgatttattttagttgttgggagttttaatttataagtaggtttgtttatttggtagtggttgtatgtaggtaggaggggttttggtagtttttaagagtgaggggttgtttagtttttttttagttggaaaggaggttttaggttgggtaggagtatttggggaaatttagtttttggagttaggttatattagggagatgaggttgttagaagtttttttggtgtttatagtaaaatataattaaagtgggatttagattttaattagtttaaggtttgatttatattagagggaaattagtgtttgttgtatgagtgagtgtttatgtgtgtgtaaggtagagatagattttgggtaagtttttttatttttttatgtttgtttttttatttataaaatggggtaatattatttattttatagggttgttatgaaataaatatgtattaatatttgtaaagtgttgagaatagtatttggtataaaataagagtgatagatttgttaaataagtaaaaaataagatataagtttaaagtagagtttggtatattgtgagtattaagagttgtgttttttgattttttttttttgtggagatttttttattagaagtgggagggattgttgaggttggagttttgttttagggatttttgtggggagttttttagtttagagggatttgttttatggattatatttgttttgggtttttgtgtttttgtgtatgtgtgtatatatgtgtgtatatatatgtaatgtgtgtgtgtgtatttttatggatttgtgataatttgtatatatatgtttagaatttatttgatatagtgttttattaagatgttggagttttgatgaatggattgtggggttgagatattgtttttataggaagttgttttagtagtaagttttttggtttttatagataattaaaaagaatggagtttgtttttattttttgttttaaaaatgatgtatagtgtgtggggtttgatgttggaggtttttttagtagatatatttttaataatattatattttgaaatttaagttgttgtaaaataagataagtaaagatggtattggtagggatttttgaggttttttttatgtatttttgaataatttttatatggtttttgtttgaatgtttttaggtatggggaatttattattttgtgaaatagtttgttttattgtttttaagtgaatattgtgagaaaaatatttttttttgtaaagagttaagttttatttgttagtattttttaggtatttggtattagttttatattttgggggaatttaaaataaatgttttttttttattagataatttattaattatttggagatagtggttgtagttttttgttttatgtagttattttatttagtttttttttggaatttttgatgtgaatataagtttttttgttatgtaggttttttttttgggttttttatttatttgtgtatattttggagaggttgtttgttttgtgggtgagatttattgtgggttgaattgtgtttttttaaaagatatatgtaagttttgattttttagtatttatgaatgtgattttatatggatatagggtttttgaagatgtaattgggttatttgagggtatattgaattagagtgggttttaaatttaatgataggtgtttttataagatagaggtaggttgggtatagtagtttatgtttttaattttagtgttttgggaggtaaagttttattgtttgagtgtaggagtttgagattagtttgggtttttgtttttataaaaaaattaaaaaattagttaggtatggtggtgtgtgtttgtgttttagttatttggaaggttgaggtgggaggattgtttgagtttgggaggttgaggttgtagtgagttatgattatgttattgtattttagtttggaggatagaatgagaatttgtttttaaaaataaattaaaaagataatagagagggtagtttggatagagatataagaagagatatagggtgaaggttaggtggggggtaggttgagttgtaagttgaggaatattaggggttgttggttgttgtagagtttggagaaaggtatgggatagttttttttggaatttttaggaggaatgaatttttagatattttggtttgggatttttggttttagaaattttagggaagatattttggatgtttttgtttttgtttttgtttttgtttttgagatggagttttgttttgttatttaggttggagtgtaatggtgtgattttggtttattgtaatttttatttttaaggtttatgttatttttttgttttagttttttgagtagttgggattataggtatttattattatgtttggttaattttttttttttttttgtatttttagtagagatggggttttattatgttagttaggatggttttgattttttgattttgtgatttaattgttttggttttttaaagtgttgggattataggtatgagttattgtatgtggttgattttggatgttttgagttattttatttgtggttttttgttatgatagttgtaggatagtaatatagggttttagtagggtggtttggtaagggttttttttttatggtagtttttattttgttttatttgtagggttatttagatgtttattttggttttggttagtaagtgttagtgtatttttttatgtttagtagtaagggtagtattgttgttgattaagtatttgttatgttggggtttttgtgtggttttggggttttttttttttgtttatatttggtagtttagtttttttttttgtattttatttgatgttggggttttgggtaagtttgggggatttgtgttttattttatagattttttagttgattttattagtttttgtatagggtttgtttgaagggttgttgggttgggtgttaattagagtttttagtagtagtttttttggttttttgattttggtttatgttttaggggtagggtttttaagggttttggggttgtttttgaggttagtttttttgttgattgtagtttatatagaggagggtttaattttgagtgtggttgtttgtgattttgagagatgtttagagttgtagatgtgttttttaagttttttagagtttgggataggagttatttaatgtttttagtgttataggtaaaatttgttttttttaatataaattgtttttagttttatttaatgttttttttaatgagtagtaataaaaatatggttttttgttaaaggtggggtttatagttttttagaatttggttttttgttaggtttaggtataatttataggagtgtttgtttttgatttgtgtgtgtgtgtgtgtgtgtgtgtgtgtgtgtgtgtgtgtgttgtgtgtatgtgtatatgtgtttgtgtaagtttttttatgtgtagttttgggaagggtggagaggtttatggaaattttttttggtatttagtaagttagaaaaaaggaaaatgagatttgtgtatatatgtgtaagtgtatatatagtatataggtatatatatatatatatttagtatatattatataggtttatatgtgtatatatgtgtaggtatatattatataggtttatatgtgtatatatatgggggtatatagtatataggtatatataggtatatatatttttttgtaggaaagtttttttttgttttttattttgtagggtttttaggttttatgaaataagattgaattttggaagtttgataaaaggtttgtttggagtattttggttatttttattagtttttttagttgtggaaggtatgttttgtggtatttatttattttttgtttttatttttatttttgtttttgtttttttttttttgtttttttagtttatatgttgtttgttttaattttaatttttgtatttggatgggaattattttttttgtagaagggtgtaatgtatgtggggatatatatatatatatatatatatatattgtattggaggagagaagagaggtagagttttttttagatttagagttttagtgagtgatgggattttttttagagaatatgtgtagaagtttgtgttattggaagaagatattattttgatttatattttttttttttttttttgttttttttatagagaaggaaaggttttagtaaatagtggttatgtgggttttttgtatgttattggtagttttttagttaggattattttttttttatttttggaagtataagaatagagagaagggtgagtttttgtttttgggggtttttttttgtatttttttggagttaattttagggttgtgggttgtataggaaggagggtttaataggttttttgtttaattttgtttttttagtgaggagttgatttattttgtttgtaaaagatgttggttgggatttgatgttgggtaatttgaggagaagagaagggggataggggttgaggttaggtttttggttttgaaatagttataatttttggggtagagtttaagggtgttaggttggagattttatatttggttagttggtagttattattttggtttagttagtggtttagggtattatagttatttagattaggaattttatttttttggattgtattaatgaggaaggttgagtttgtaggttttatatatttatggtaattttaaggtagagaggttattgttaattgagggttatgggtaggagttttgtgagtttattagtaagtttggaagattaaggtttttggttatagagagtagttgttatttggttaattttgtagaaaatattatagttttggataaaatatttgaaagaataaaataataatagtttggagttagtatagaatattttaagtaggtagaagttggagtagagtttatatttgatagaggggaataaaattagataagtttttggtttttggaggtttttttgtttagaggtaggtattgagtaattaaatttggataaaaagttttaaaagtatttagggaaaaataatatgtggtttataggggaatagttagatgaatgttgattttttgatagaaataatggaggttaaagatattggaattttatattttaaagttttgaaagaaaaaattgataatttagaattttataattagtgaaattatggtttaagaatgatagtaggttgggtatagtggtttatatttataattttagtattttaggaggttaaagtaggtagattatttgaggttaggagtttgagattagtttggttattatggtgaaattttatttttattaaaaatataaaaattagttgggtatgatggtatatgtttgtagttttagttatttgggaggttgaggtaggagaattgtttgagtttgggaggagaaggttggtgagttgagattgggtaggagttttgaaattatattattgtattgtagtttgtggggagatagagtgagattttgttttaaaaataaaaataaaaataaaaaaagaaagaatgatagtaaaataaagatttgtagataagtgaaaatgaaagggaattagttgtttgtaaatttgtattataaaaattgtgaagtaagttttttaagattatgggaaatgagattagatgggaatttagttttttaggaaggaatgaagagtataggatatagtaaatatatgggtaaatagaaaagattttgttttatttttaatttttttaaaatgtatggggttgtttaaagtaaaaatttttttattgtattgtttagtttataatgtgtatggatgtagtaaatatttaataattattatatataggatggaaagtggtaaatgaatttataggattgtttagtttttatattttttttttatgaagaaaaataatgttaattttaagtagattgtgaaaagttaagaatgtgtaatagaatttataaagtaattattaaaatagtaatataaagagatataattaaaaagttaaaataggttgggtttagtggtttatgtttgtaattttagtattttgggaggttagggtgggtggattgtttgaggttaggagtttgaggttagtttggttagtatggtgaaattttgtttttattaaaaatataaaaattagttggttgtggtggtaggtgtttgtaattttagtatattagggaagttgaggtaggagaattatttgaatttaggaggtagaggttgtagtgagttaagattatgttattgtattttagtttgggtaatagagtgagattttgttttaaaaaaaaaaaaaaaaaaaaaatataaattaaaatagaattttaaaaaatatttaattaatataaaagaagttaagaaagtaagatgaaagaaataaatattaaagagtaaggtagtagttttaaatttagttatatttataattatgttaaatagaaatagtttgaatattttaattaaaaggtggaggttgttagaatgaataaaatagtaagatttaattatatattatttataaaagatgttgttttagtataaatataggttgaaattttttgtttggaaaaagatatattgatgttgtttgaatgatgatggagttatgttttgataaatttattataagtggaaaataaatattattttaaaaatgtatttaatatatttaatttattgaatattttagtttagtttagtttattttaatatgattagaatatttattttagtttatagttgagtaaaattaataaatataaagtttattttataataaagtgttgattattttatgtaagttattgaatattgtattgaaagtgagaaatataatggttttatatatatttaaagtatagtttttattgtatatatattatgtttgtattatggtaaagttgaaaaattgtaagttaaattattataagtttttttataagtttttttagtttttttatgtattttaaatagtatgtttaagaaggttggagaggttatataaatattaataaagttgagtttaagataaaattattatgagataaaggaatatatttattatggttaaatgattagtttattgagatattattataattataaatgtgtatgtatttaattaaaggagttttaaaatatatgatataaaatttgaaagaattaaagggagaaatgggtaattttataattataggtggagattttttttttttttttttgagatggagttttatttttgttgtttaggttggagtataatggtgtaattttggtttattgtaatttttattttttgggtttaagtgatttttttgttttagttttttgagtagttgggattataggagtttgttattatgtttagttaatttttgtatttttagtagagataaggttttattatgttgtttaggttggttttaaatttttgattttaggtgatttatttgttttggttttttgaagtgttgggattataggtgtgagttattgtgtttggatgtatagttggagattttaatattattttagtttatttaggatgttaaaataaaatgttttaggttgggtaatttataaatagattgtagtgtttatagttttagaggttgggaagtttaaaattagggtgtttagtgtttggtgagagttagttttttgttttagagatgttttttttttgttgtgtttttatatggtagaagggattaattttatttatgatgattttgtttttatgagttaatatttttttgatgttttaatttttaatattattgtattagagattaagttttaatatatgaattttgggggatataaataggtaggttatagtaaatattatttttttaatatttgagaaataagtattagataatttgaagaatattggtaattagtaattgatttaattagtagttataaagttttatatttaggaagtttagaatatatatatatattttttttttaagtgaaaatagtgtatttattaagatatatattttgggttataagttttaaattttaaaagtatgtaaaatatgtttgtttggttaaagtaagattaaattagaaattaatagttttaagatatttagaggagttttgattatttgtaaattaaataatatatttttaaataatttatgagttaaagaggaaattataagaaaaattttataatattttaaatgaaatgataatgaaaatatagtatattaaaatatgtaggttgaagttagtgtttagagggaaattgtaagtgtttatattagaaaagaagtaaaaaaaaaaaaaaaaaaaaaaaaaaaaagatttaaggatttgttttaagaatttggaaaaatgggttaggtgtagtgtagtttatgtttgtaattttagtattttgggaggttaaggtaggtggattatttgagattaggagtttaagattagtttggttaatatggtgaaattttgtttttattaaaaatataaaaattagttgggtatggtgggtatttttagttatttagaaggttgaggtaggagaatggtttgaatttgggaggtggaggttgtagtgagtttagattatgttattgtattttagtttgggtaatagagtaggatgtttttttaaaataaaataaaataaaataaaataaaataaaataataaaaaaaataaagaatttggaaaaatatgttagttatttatgtattgttttttaattttgtatatattttgttaggttttgttttgtgatattggattgaggttttatgagtttttttttttggttaaatatagttatgttaggttttatttataggggataatattgtggggagttgttaggttttgttgaggtagtagtttttttttttggttttagggttttttttttttttgaaggtatagttgttagtggtgtgtgtttagtggggtttgttttgtattgagtttttttagtattttagttttagtttaatgggattttagtaaattttttagatatttagtttttgtttatttatattttttagtaggttttttggttatttagtaagttgattttgtagatttattttttttatattttttggtaagaatttttttgttattagtaggttgtaggtttttgtggtagttatatattttttaataaggtttgaatgtaagatgtggtaaggtgtggaggatgttttgagtttttggttttttttttattaattttagtggtagtaattgtttttgtgtgtttgtatatatgttttaaagtatttattatagaaaatttattattttaattatttttaggtgtgtagtttggtggtatgaagtatatttatattgttgtgtaattattattattatttattttatttttttaaattgtaattttatttttattaaatattaattttttatttattttttttttttttagtttttggtaatttttattttattttttgtttttttgaatttgattattttagggattttataaaagtgaaattatatagtatttgtttttttatgtttggtttttgttatttagtatgtttttaaggtttatttatgttatagtatgtgttagaattttttttttttttttttttttttttttttttgaggtagttttgttttgttgtttaagttggagtgtagtggtatggttttggtttattgtaatttttatttttttagtttaagtgatttttttgttttagtttttttagtagttgggattataggtatatgtttttatgtttggttaatttttgtatttttagtagagatagggttttgttatgttggttaggttagttttaaatttttgattttaagtgatttgtttattttggttttttaaagtgttgggattataggtgtgagttattatatttggttttttttttttttttaaggtagaataatattttattgtatagatggattatattttgtttgtttatttatttgttggtggatatttgggttgtttgtattttttggttatgggaaaagtgttgttataaataagaatgtagtatatttgtttaagtttttgttgttagttttttggagtatatatttagaagtggaattattggatgttatggttattttgagtttaattttttgagtaattgttatattttttttatagtagttgtattattttatatttttattagtagtgtatggggttttaatttttttatatttttgttaatatttgttgttatttatgttttggttaatagttattttaaagggtgtgaaattatattttattgtggttttgatttttatttttttgatgattagtgatattgtgtatttttttttgtgttttttggttattggtatgttttttgtggaaaaatgtttgtttattgggttgtttttttttgttttgtggtttagttgtaggagttttttatatattttggatattagttttttattggatatatgatttttaaatatttttttttattttgtggattttttttttatgttattggtagtattttttgatgtataaaagttttaagttttggtgaagtttaatttattatttattttttttgttgtatttttggtgttatatttaagaaagtattgttaattttaatgttatgaagttttttttttatgtttttttttaaagtagttgttttttatatttgttttttttatattttttagagtttttttgtataaggtaaaataaattttatttttttatttttatttataatatttagtgttttagttttgatattagatgtgtggtttttttttgttgatttttaagtaattttttaatatttagtagtttttaattgggtgttttgtaatttagtttaattttgatattaattagagttagtgtagattttataggttaagggttttattttataagattgtttttaattttagagattagttgtaagtggtaagatattaggttatttataatttttgtttgatttggttataaatttgaggtttttataattttttttttaggtttaataatttgtttgagtgatttatagaatttaggaaattagtttatttaaaattgttgatttattataaatgatattttaaaggatataaatgaatagttaattggaagagatgtataagaaaggtatgaaggaagtggtatggagtttttatgggagggtatattgtttttttagtatttgtaggtatttaataatttgaaattttataaattttatttttttgggtttttagggaggttttattatataagtatgatatgaaatttttggttattgatgattaatttaatttttatttttttttgttttgtaggaggtggatgggaaaggttgtaagttttagttttttaattataaggttgggttttttggtaattagtttttatttttaggttgtttaggagtttttagttattagttgtttttttagtaaataaaaagatatttattattttggagattttaagagttttaggagttatatgttaaataaagttgggggatagagattagatagatagatagatagatagatagatagatagatagatagatagatagatagatatattgatttttgagatagagtttttttttgttatttaggttggagtgtagtagtgtaattttggtttattataatgtttgtttttttgggtttaaattatttttttattttaattttttaagtagttggaattgtaggtatatattgttatgttaggataattttttgtatttttggtagatatgaggttttattatgttgtttaggttggttttaaatttttgagtttaagggatttgtttgttttagttttttaaagtgttgggattataaatatgagttattgtattgagtttagtttaaatatattttttttatattataatgttatttttttgtgatttttttaatagttaattattttttatagttaagaatattttatattataagttgttatttaaattgttggtgtggtttttgttttttgattgggttttgattaatgtgttgaagtaagtataaggaaggaagtaatgaagataatagagaaatttaaggaaatggatattagaaaaggggagtttaatgttggttttttaaaaagatttagattgataattttttagttaggttgttgatgagagggagatggtgaatataaagttataataaaaggaatgaagtgttttttttatggattttattgatattatagtgataaggaatataggtatattttattttattgtgttttatagatattgtattttttataaattgaaggtttgtggtagttttgtattaagtaagtttgttggtattatttttttaataatatgttaatattgtgtttttgtgtaggagtttgatgatttttgaaatagtttaaatttttttattattattatatttgttatggtgatttgtgatttttttttttttttttttttttttgtttttttttttttgagatagagttttgttttgtttggagtgtagtggtgtgattttggtttattgtaagttttgttttttgggtttatgttatttttttgttttagttttttgagtagttgggattataggtatttattattatgtttggttattttttttgtatttttagtagagatggggttttattgtgttagttaggatggttttaattttttgattttatgatttgtttgttttggttttttaaagtgttgggattataggtgtgagttattgtgtttggttttttttttttttttttgagatggagttttgttttgttgtttaggttggagtgtagtggagtgtagtggtgtgattttggtttattgtaatttttattttttaggtttaagtgatttttttgttttagtttttttagtagttgggattataggtatttgttattatgtttggttaattttggtatttttagtagagatgaggttttattatgttggttaggttggttttaaatttttgattttaggtgatttatttgttttggttttttaaagtgttgggattataggtatgggttattgtgtttagtgattagtgatttttaatgttattattgtagttgtttttggggtatgatgagttatatttagataagatagtgaatttatttaataaatgttgtatgttttgattgttttattgattggttgttttttgttttttttttttttgtttaggtatttttattttttgagatttaataatattgaaattaggttaattaataattttataatggtttttaagtgtttaagtgaaaggaagagttatttgttttttattttaaattaaaagttagaaatgattaagttgagtgaggaaggtgtgttgaaagttaagataggtaaaagtgagattttttatgttaaatagttagttaagttgtgaatgttaagaaaaagttattgaaagaaattaaaagtgtgattttagtgtatatatgaagaagaagaaagtaaaatagttttaatgttgatatgaagaaagtttgagtggtttggatagaagattaaattagttataatatttttttaaataaaagtttaatttagggtaaagttttaattttttttaatggtatgaaggttaagagaagtgaggaagttggagaaggaaagtttgaggttagtagaggttaggttatgaagtttaaggaaagaagttatttttataatgtaaaagtgtaaggtgaagtagtaggtgttgatggagaagtggtagtaagttatttagaagatttagtttagagtattgatgaaggtggttatattaagtaatagaattttagtatagatgttttattttttattggaagaagatgttatttaggatttttatagttagaggggagaagttaatgtttgtttttaaagttttaaaggataggttgatttttatgagaggttaatgtagttgttgattgtaagttaaagttaatatttattgattgttttaaaaattttagggtttttaagaattttgttaaatttattttgtttatgttttagaaatggaataataggttttatttgatagtatatttgtttatagtatggtttattgaatattaaaaatttattgaggtttggtgtggtaatttatgtttgtaattttagtatttttgaaggttggggtggggggattatttgaggttaggagtttgagattagtttggttaatatggtgaaattgtatttttattaaaaatataaaaattatttaggtatggtgttatatgtttgtaattttagttatttgggaggttgaggtaggagaattgtttgagtttaggaggtggaggttgtagtgagttgagattgtgttattgtattttagtttgggtaatagagggagattttgttttaatttgaaaaaaaataaaaaaataaaaaagggttaagtatggtggtttatagttgtaattttagtattttgggaggttaaggtaggtaaattatttgagtttaggagtttaagattagtttggttaatatggtggtgaaattttatttttattaaaaatataaaaattagttaggtatggtagtgtatatttgtagttttagttatttaggaggttgaggtaggagaattatttgaatttgggaggtggaggttgtggtgagttgagatagtgttgttgtattttagtttaggtaataaagtgagattttgttttaattaaaaaataataataaaaaaaaaataaatagggtttggtgtagtggtttatgtttgtagttttaatgttttgagaggttgaggtaggtggattatttgaggttaggagtttgagattagtttggttaatatggtgaaattttgtttttataaaaaatataaaaattagttaagtatggtggtgtgtgtttgtaattttaattatttaggaggttgaggtataagaattatttgaatttgggaggtagaggttataatgagttgagattatgttattgtattttattttgggtgatatagtgagattttattaaaaaaaaaaaaaaattattgagatttattgtttaggaaaaaagaatttttttaaaatattattgtttattgataatgtattttgtgatttaagagttttgatggagatgtatgtaaagatgaatgttgtttttatgtttgttaatgtaatatttattttgtagtttatggagaagggataaatttgatttttaagttttattatttaagaaatatattttataaagtagtatttgttatagttagtgatttttttaatggatttgggtaaagtaaattgaaaattttttggaaaggattttttattttagatgttattaagaatatttgtgatttataagaagaggttgaaatattaatattaataggagtttggaagaagttgattttaatttttatggatgagtggtttaagattttagtagaggaagttattgtagatgtggtggaaatagtagagaattagaattagaagtggagtttggagatgggattggattgttgtaattttatgattaaatttgaatagatgaggagttgttttttatggatgagtagataaagtggtttttggagatgggatttattttaggtgaagatgttgtgaatattgttgaaatgataataaaagatttagaatattatattaatttatttgattaatttgtggttagggttgaaagaattgattttaattttgaaggaagttttattgtgggtaagatgttattaaatataatgtgtgttatagaaaaattttttatgaaagaaagagttaatttatgttaaaaattttagttaagaaattgttggttaggtgtagtggtttatgtttgtaattttagtattttgggaggttaaggtaggtggattatttgaggttaggagtttgagattagtttggttaataaggtgaaattttgtttttattaaaaatataaaaattagttaggtgtggtggtaggtatttgtagttttagttatttgggaggttgaggtaggagaattgtttgaatttgggaggtagaggttgtagtgagttgaaattgtgttattgtattttagtttgggtaatagagtaagattttgttttaaaaaaaaagaaaaagaaaaaagaaataaagaaattgttgttatagttatttttaatttttagtaattattatttggttagtagttattaatattgaggtagattttttattaagaaaaagattatggtttgttgaaggtttagatgattattagtattttttagtaaaaagatataatgattttatatattttaatagattatagtatagtgtaaatataattttttttttttttttttgagatggagttttgttttgttatttagtttggagtatagtggtgtgattttagtttattgtaatttttattttttaggtttgagtaatttttttattttagttttttaagtagttgggattataggtatgtgttattatatttagttaatttttgtatttttaatagagatgaggttttattatgttggttaggttgtttttaaatttttaattttaaatgatttgtttattttggttttttaaagggttaggattataggtatgagttattatgtttggtttaaatataatttttatatgtattgggaaattaaaaagtttgtgtgatgtgttttattgtaatatttgttttattgttgaggtttggaagtaaattttaggtatgtttgtattatgaataattttaaatgagtaaatttaataatttatttgaaagggataaatttttttaaagtataatttattaaaagtaagataaggggaagtaaaaaaatttgaataattttttttatatattaaattgaatttgtgattaaaaataaataattattttttttagtagaaaattttaggtttagatggtttttttggtggattttattaaatatttaaggaagaaataatattaattttatgaaaatatagaaaataaagagaagggaatatttttaaattaattttatgaagttaaaatgaggttgataaagatattattgaaataaattaataaataaagaaaatattatattaatattttttatgaattaatatgtaaaaatttttaaaaattgggtaaattaaatttagtaatatataaaaaggatgatattttataagtaagttggattttttttagaaatgtaaggttggtttaatattaaaaaattaggtttgtatagtggtttatatttgtaattttagtattttgggaggtagaggtgggagtattgtttaagtttaagaattgtagattagtttgagtaatataatgagattttatttgtataaaaaattttaaaaattaaaaattagtttggtatggtggtatgtgtttatagtttttgttatttaggaggttgaggtgggaggattgtttaagtttaggagtttaggttgtagtgagttatgatggtattattgtgttatagtttgggtaagagtgagattttgtttttttaaaaaaaaaaaaaaaaaaaatggggggtaaaaattaattattgtaatttattttattaaatgaataaaagataaaataatgattatttttatagatgtagaaaaagtatttattaaaattatatttatttatgttaaaaaattttagtaaattaagaatagaagggaatttttttaatttgataaaggttatatatgataaatttaaagttaatattataagtttggtataggtaaggatgtttattaattattattatttaatattgaattggtagttttaattagtgtaataaagtaagaaaaaaaaataaggtattaagattagaaagaagtaaaattatgtatttaaattttaaaagatttataaaattattattagagtaataaatgattttggaaaagattataggatataagatttatatataaaaatttattgtatttttatatattagtagtaaataattaaaaatgaaatttaaaatttattttagtttaaaatagtgttaaaagtaaaatttttaggaataaatttaataaatggtatgtaagattttttttttgaaaattataaaataatgtaattttgtagagatttttttttagtagagaaataaaagaaatataaaaggatttttaaaatggagatatattatttatataaaagatttaatattgttaaaatgttaatttttttttaattgatttatagatttaatataattttaattaaaatttatattgtatttttgtagatattaataagttattttttaaatttataaggaaatttaaaggatttagaatatttaaagtaatattttagatatttgagagattttatattaagatttattgtaaagttatattaattaagatgtggtattagtaaaggaatggataaaatattaagaaaatataatagtgttttaatatagggtttatatgtatatagtatatatattaatataggattatatatatagttaatataggatttatatgtatatagtatatatattaatataggattatatatatagttaatataggatttatatgtatatatgtatatatattaatataggattatatatatagttaatatggggtttatatgtatatatgtatatatattaatataggattatatatatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatagggtttatatgtatatatgtatatatattaatataggattatatatatagttaatatggggtttatatgtatatatgtatatatattaatataggattatatatatagttaatatagggtttatatgtatatatgtatatatattaatataggattatatatatagttaatatagggtttatatgtatatatgtatatatattaatataagattatatatatagttaatatggggtttatatgtatatatgtatatatattaatataggattatatatatagttaatatggggtttatatgtatatatgtatatatattaatataggattatatatatagttaatatggggtttatatgtatatatgtatatatattaatataggattatatatatagttaatatggggtttatatgtatatatgtatatatattaatataggattatatatatagttaatatagggtttatatgtataaatgtatatatattaatataggattatatatatagttaatatagggtttatatgtatatatgtatatatattaatataggattatatatatagttaatatagggttgatatgtatatattaatataggattatatatatagttaatatagggttaatatgtatatatgtatatatattaatataggattatatatatagttaatatagggtttatatgtatatatgtatatatattaatatagggttatatatatagttaatgatttttagtaaaggtgttaggtaatttaatagagtaaggtatgtttttttaataaatggtgttagaattggatatgagtatagaaaaataagaattaattttgattttaaattaaatataaaaattgatttaaaatggattatataatattttgatggttataataggttaaaaaatgtaaaaatttaaaaaattaaaaaataaaaggaattatagaatatataattataaaatttttagaaaataagagaattttttttgattttagtgtaggtaaagattttttttataggttataaaaattataaattgaaattggaaaaagttgataaattggattttatgaaaataaaatatttttgtttattaaataatattattaagaaaattaaaaggaaaggagtaatgtggaaaaaaaaatttatgatatatatatttgataaaggatttatatttagaatatataaaaaatatatgaaataatatttttttttttttttttttttgagatagagttttgttttgttatttaggttggagtgtagtggtgtaattttggtttattgtaagttttgttttttaggtttatattatttttttgttttggttttttgattatttgggattataggtgtttgttattatgtttggttaattttttgtatttttagtagagatggggttttattgtgttagttaggatggttttgattttttgattttgtgatttgtttgttttggttttttaaagtgttgggattataggtgtgagttattgtgtttggttaattttttttttaaatgagatttatggggaaatagttaaatgaagaaataataaagtagtaataaaataaaatttaagttttattttattgtgtagttgtaggataaagagtagaagtttgtagttggggaataaggtgtttatttttttaagtattataaaatgaaggttttagaaattatttgattttgaaataatataattttaaaaagaagtaagatgtggatagataattttataaaggaaaatatgtaaatgattaataaggattttggaaaattgtgtgattttataagttattaagaaaatataaaataaaagttttaaaaaaaaatgaagtttggaataattgaataaatatataaaatgataataaaatgaattttgattttttattttatattatatgtaaaagttaatttataaaagttatataattttaagttttttaaaggaaaatataaatatttttgtaatttggtagggtaggtaaaggttttttataaagaatatagagagagaattataaagaaaggagtttgttaaattagattttataaaaattaaagtgatatatttttgtttattggaaaatattattaagaaaatgaataggttgggtatggtggtttatgtttgtaaaattggtttttggggaggtagaggtaggaggatagtttgagtttaggagttttagatttgtttgggtaatatagtgagattttgtttttgaaaaaggaaagaaaatgaataggtaagttatagattggaataaaatatttgtaaaatatgtatttgataaaagattagtatttagaagaaaaagttaagtaatttaattttaaaatgagtaatagatttgaaaagatattttataaaggaaaaatatatgaagagttaattatgaaaatgtgtttaattgtattagttattaggttaaagtaaattaaagttataatgagatgatattattatatgtttattagaatgattaagattttatagagtgatagtattaaatgttggttaggatgtggagtaattagaatttgtatttattgttggtgggagtgtgaaatggaagggttattttgggaaaagatttggtagttttttataaaattaaatgtatatttattttatatttattttaggtgtttttatagaataaatgaatgtttatatgtatagaaaaatttgtataagaagaattagtgtaataggtttatttataagagtttttagatggaaatagttaggggttttttaataagagaatgattaaaaatttatagaatgtttatatagtggatgttatttagtaataaaatagaataaattgttggtatttgtagtaatatgggtagttttaagaaatatttaaattggtaaaattattttgtggtggaaaaaaagtataattgtggttgttttggggaaggtggggattgtgatgtatttggaggggtatgaggaatttattggggtgatagtgatgttttatgttttggttaggttgggatatatgtggatatttttgttaaaatttaaagaatggaatgttttatatttgtgtattttagggtatatatattttattttaaagaaaaataaaaataattatagataaatgttggattttagttaatgaaatgtaaattgaggtgttgataggatgttgtgtgttgatttttgtagtttattttaagtgtattaaaattagtgtggatgttggtggttagagggatttgtggtgaagtaaatagtaaaatggttgttgtggaatttaggtggtaggtgtatgggtgtttattttagaattttttatggttttttttttgtggttttgttttgttttgtttttgagatagggttttgttttgttgtttaggttggagtgtattggtataattttagtttattgtagttttaattttttaggtttaagtaatttttttattttaattttttgagtagttgggattttaagtttgtattattatgtttgattaattttttgtattttttatagagatgggattttattatattgtttgggttggttttgaatttttgggtttaagtgatttttttattttaattttttaaagtgttgggattatagttatgagttattatatttagtttttttttattttttttatgtttgaaaagttttatggtaaaaagttggaaaaatgtaaaaaagattgaaatttattaattaaaaataggaaaaataaaataaaagagatggtaggagattattttttttttttttaatttagtttttaattttttttttttttgtttagttaggataggaattttaagggtttgggttttttgtgtttgtgtggggaaggaggtatttttgtgtttgtgtgggggttggttatttgttttttggtgtattttttgtattttatttttttttgtttgtagtgagtagttatagttggtggaaattatatttaggtagtttttgtttataaatttagtgaaaatgtaaattttgtaggagttggatttttgagagtttgtggtgttatttgttggaggaaaggttttttgtatttgagtttttttttttttttttgttgttatttgtttttttgtttaggttgggtgggttttttttttgtaattttggggtattggtgtatgggaaatgtttagtgttttataatttttttttatttatattttaatatttagtttttagtggatattgtttttgtttgataaatatattatataggtatagtttaagattatttattttaggaggagtataagttttagtgtttattattttagtttttttttttttttttttgatgtagtgatataggtttaggatattgaagatttttgattttataaatatgttgaagttaattattttgaagttgtagtttttattattattattattttttattttttgtaaagataaagttttgttatgttgtttagtttggtttggaatttttggatttaattgatttttttgttttggttttttaaagttttgggattgtaggtgtgagttattgtatttagtttgaagttgtagttttttaattattgttaatagtaatatttatttttttgtgagtagtagggtttgttggtatggttgatagttttgtattattgtattgaatttgttgtttgggattttaggtgagttttgatttttagttggagggataagttgtgtggggttgggtagggtgaattgtgggagattaagtttagattgagggttataagttatatgagtattggggttaggtagggatagtgaaggagatagtgtaattttgaggaaagataatgttatagaatggagaggtttaggtttggggtttttttttgttgttggataggtatgtttgtgttttttttttagtttttgtgatggttaagttatgtgttttttgagaggtaagtgaggtttttgatagtaggttttaggttttaattaaattgtttgttttgtagggtgagttgtataggtgtttttatttttgatttttttgaatttttgttgtttttaagttttatttattttttttaggtgaatagaaatattgtttaggggagaatggaggaagaatttaggaaaggttgtttgagagtttggttgagtttatgttattgttaagagtagtgttaaaatttaggagttggtgagattatggtttagggtttatattaatatgagggggtgttagttttatgattaatgagtttttgttttattattttttgttatttatattttgagggttatagttagtatgtgaattggagttggtttttggtatttttttttttatattagttttataatgtgaggtgggggtttgtttttagaggtatttggagtagtaggtgttttaagagggggaagtttttttgaagtttttttttatttatggtataggatgtagaggggatagagtattaggaatatttagtgattataggggtttgttttgaaggagaggaggtaggaggtagggagagtggttgggaggttagttttggagtgtttattttttattttgagggagaggaaggaagtagaaggtgagtatagggagttttagttggggatggagtgggggttgtagtttgattgtgttgtttggagtgggggtatggattgtagtttttatttatttgtttggttagtttgaagttattttaagtttggagattttatttgttttgtttattttttttagggatggtgtttaaattttgaagttttggttggtgttgtaaatatgggagggaggttttgttttattttagttttaagagttagttaagaatgttttggatatttgaattttgttttgagttagaggttgggaagaaatttgaaggatggtgggatggtggatagtagtttttaggtattaggtattagggtttttgtttggggatgggggtattagtaggtgttaagtgtattatattagggtttattatgtttttgtttagagatttagtattttatgaaataggaaggaatgagggatgagtgtgtttttttttttaatattttagtttttgttttgaggttgttaggtatttaatttttttaggatttaaattattttggttttatttatggttaagtgtattaaattatagttaggattattgggtttagatattaaaagtgttttttttaaagttggtagttattagggtagtatagggtagtgtaaggttgggtagggttggttatttgttagtatttagtggtttttgttggatgttgatgggggtagttaggtaggtgggtttatttagtaattaaagagattttttttttttaattttttttttaaagagattttgattttttttttttagttgtagggtttgtagtagttttttttttagtaggtttttttgtttgtttttggttatttttagtagttatagggtattgaggttttattatagtgagaataaaattaagtttttattagggtttttaaggtttggtatgatttggttttgtttgttgtattggtgttattatggtttgtttttgaaaatatattttagttatttttattttttttaggttttagttttgggtttttatatttgttgttttttttgttaggttgttttttttttggattttggtttggttgggtttttttggttattatagttttagtttagtgttattatttagaaagggtttttattaatttttttgttatatatatagatatgtatttttagtaatttgtttttagtttttttatagtttttatttaaaattatttatggatttgtttatttgtggattgttttttagttttaattgttaagtaataagtgattagtgattgtgtttttgttgttttttattataggttaagtatttaagagaggggttgtatatagtaggttttaataaatatttattagatgggttaggtatggtggtttatgtttgtaattttagtattttgggaggttaagttgggtggattatttgaggttaggagattgggattagtttgattaatatggtgaaattttatttttattaaaaatataaaaattaattaggtatggtggtggatgtttgttattttagttatttgggaggttgaggtaggagaattgtttgaatttgggaggtggaggttgtagtgaggtgagatggtgttattgtattttagtttgggtgatggagtgagattttgtattaaataataataataaaatatttgttagaagaattaaagtagtttgtttgtgtttaataggaatttaagagtataagatgaatttaattaaaggatatatatagtaggtattttatagttgatatttgttggtggagggagattaggaaagtggggagaggtagtgtttgggtatggggatattttgggtatggggatgttttggatatagggatatattgggtatggggatattttgggtataggatgttttgggaatggggatattttgggtatggggatattttgggtatggggatgttttggatatagggatattttgggtatggggaaattttgggtatggggatgttttggatatagggatatattaggtatggggatattttgggtatggggatgttttggatatagggatatattgggtatggggaaattttgagtattgggatgttttaggtatggggatgttttttgttatttgaaattttgtagttttattatatttgtttgttttagtaaattggtttaaagagtatttttaagtttttatggtaaagttttagagttagtgtttttttgttgattttgagggtgtgttgtttatttagtgtttaagttagagtttttttatttagaaaaaaaaagaggagggtggttttatggatggaggtatgagggtgtttataggtagagggagtttttgggttgagatttgtgttattttttgttttaattttaaggtgtagtttggagtttaaattagtttttaaatgtgggttgttggttaagaggaatttttttatttatgatttttttttatatttagtttttattgtttagagtatgttagttttgtttgttttggtttttaggatttttttagggatttttaggttttaagttagggtgggtttgaattaaggtagttttagaatttatgttaatgtttttgttagtgggagattttggggagtattgtgtgggatgtatggggttaggtgggggtatatagtgagtggttttagaagttttggttgtttggagtgggggggtgtttagagtaagagatgggttaggaagttggagtgagtaaggaggttttagtttttggtgggagtaggttgggtaaaaataaattaatttgagggtagtagttagtgagattattataggaggggtggtggggttggaggggttttaggagtttaggagagggaggtattgttagaggtaaggttggtagatgagagttagtgttggtaggattaatttgttatagtagttatggtttattttttttttttttttttatatatgtttttggggtttatggaatttattagtttattataaaggatattataaaggatataggggaagagatgtgtagggtaaggtatgggggagggatgtagagtttttatgtgttttttaggtgttttattttttaggagtttttatatgtttatttatttagaagtttttggaattttatttttttgagtgtttatggaggttttattatgaaggtatgattgatttaattattggttgttgatgatttgtttaatttttagttttttttttttatttggaggttgtggggtggtgttgaattttgtgattttatttggttttttttgggaattattttgaagttgttagttggtttgttaattatgagtatttaaaaagatattattttggagattttaaggattttaggagttgtgtgttaggaaatggagatgaaaattaagtgtatattttataatatgatagttagttttttttaattttagttttattttttgttgtgttgttggttttagttttttgtgttttagggtttttgaatatattgttggttgtttgtagtgattgtttttgtttgttgggtttgagtttggtttattttttttatttttttgtgtttagtttgaaggtgtttttttgaggtagtttttttgatttggttttatgaattgtaggttttgttttgttattggttttttttgttatatttgttattttttgtgttttatgtttattgatgtggttttgtatttgtgtagttttatgagggtaaggattgtgtttggttttgttttttatgggattttagtgttaagtttatagggagtatttaatgttgaatgaatgaatgagtgattggtaagggaggtttattttgttatgttgggggttaaaggttgttgggtggattatatgggtgaggttgggtggggagggaagtagagatgattttttggaagaaggggtaggaggtggggaggtgggtgtggggtgttgtataaggatggtaagtgtttttaggggtgataagttaatttagagtattaggtagtagaaaaaggttgatatttttatgttttatttttatttagggagaggttaggtttttgggaaagttagttttttgttgttaggagagttttaagggaagttttattagttgttgagttggttatagtggaaatttatgtggtgggtgggaggggtttgaggtataggggtttgggtggtggttttaggatggagatttgtgtttagattatgaggggtggttttagggatgattatttttaaataggaagtagataaaggtatagatggtagaagtggaggtagagaatgggttgtaggggtttttttagagggagagttgagtaaggggataggttggaaatatttagtttttatggtttgaagtatagatagttggttttatatgtaggttgggtagttatattatttagaataaggggtatgtttgtagggtaggttttaggatgttttgggttggttttgttattagtttagaaagatggtttaggtttttttggtagggagtatgtttagttaggttttgggtaggagttgagattttttggttggtttgagaggggatgattgagtgtaggtttagtttgggatttttttatttttttttgttatttagtggaattagttgggtgtgagaaaagaagagaagtgaattaagagtttagagtatgaggttggattagtttttatattatatgtaaaaattaatttaatttgtattaaagatttaaatttaagagttaaaattataaaatttttagaagaaaatataggggaaaagttttttgatgttgtatttggtaatgattttttggatatggtgttaaaagtataggtaatagaagaataaatagataaagtggaatgttatagaagtttaaaatatttgtatattagtttgggtgtggtgatttatgtttgtaattttggtattttgggaggttgagatgggtggattatttgaggttaggagtttgagattaatttagttaatatagtgaaattttgtttttattaaaaatataaaaattagttgggtgtggtggtgggtgtttgtaattttaattatttaggaggttgaggtaggaaaattgttggaattagggaggtggaggttgtagtgagttaagattatgttattgtattttagtttgggtaatagagttagattttattttaaaaaaaaaaaaaaaaattgtatattaaagggtattaataatgtggggagaaggtaatttatggaatggtagtaaattataggttagatatgggattagtatttggatattaatttatagattttttaatatttagtaataataattatttaaattaaatataggtaaaggatttggatagatatttttgtaagaatatgtgtaaatgagtaataaatatgaaaagatgtttaatattattaattattggggaattgtaaattaaaattataaggagagattttttataattatgagttttgggtaggtaggaagatgtttggtggggagttgttggttttatgttgtttttagaatttttgtaggggttaagtttgattttgatattttattaggagtatagaaatgagtggaaaaggttaaaggttattttaaagggttagaggggtttagtaaggagtttgggatatggaattatgttgtgtatttagatatatggggataatagggggatgaaaggtggtttttaaaatttatatttattttagagtttatgaatatggtttatttggaaaaagggtttttgtagatgttatgaagttaaggattttgagatgggattattttgggttatttagtgggttttaaatttgagaaagattgtttgtatgagagatagatagggggagatttagggtatagaaggaggttttgtgataatggaggtagaggttgagtggtgtggttatgagttaaggaatgttaagggttttgggagttgttagaagttgttagaggtgagaagtaggtttttttttggagtttttggaaagaattaggtttgttgatgttgtgattttggatttttggtttttagaatggtgagagaagaaatgtttggtgttttgagttatttagtttgtggtatttggtgatggtagttttaggaaattattatagggattagagtttttatggggttgggtaggaagtgggtgtagagtgtgttaggttaggttttttattttggagatggaaaagtagagttggagaggttgagattggataggtattgagtgtttaggggtaagaatttttaggggatggtagaggttattggggatagtatagtgagggataggagggaggggtgagggttgaggtattgttttttaggaggttttggttttttgtttattgatgatttaggaattttgtaagaggagttgggttttattttgtgttgtattgtattagatggattttggtggggatagatgtttagtgatagtgtggttaagttttttttaggattttgggtttgtatttatgattatgtatagatggttattttttttgtttgtagtttttttttgtggtttgtttttagttttttagtttaatagagttttttagtggaaagttttttttttggagattttttttttgttgaaatataagtttttggaataagataaaattgtttaatttgtaaaagttataaagttgttttagaataaaaaaaaagttttgatttttggttggaaggagtggttttttatgttttagtggttagttattattttatgatttatgttggttttgttgataaattttttagtatttttttaggggaaggttatagtttttagggagggtgggagagtatttaggtttttgtttataaattagattggagttagatattgttgagggagggataagagggtaggttttggggtttttaagttttttttggggttggtagattattgtggatttattagggtaggattatttttttttataaattttttttgggtagttgtagggtagtttgagttggatatgttttatatgttagtttagtggggtatgaggtatttatagttatgtttggaagttagtgggttggtatttgttgggtaggtttttgttatataggtatagtgttttttttatggtttttttttaggttagagtatgtttggggattagagtagtttttgtagtggtttgtagtttgataatgtggtgtgagttatgttttgtagagaagaagagttttttagtgagggaagaggtgtttataaaatttaggatatgtgtagaaatttgtaggaggtgggggtgttgtttaggggttgtgttgtttttattttttattttgtagatgatggaattgtggtttagagttgttaagtggtttgtttaaggttatttagtagggataggaaggaagttatttttttagggattgtgtgggagtttagtgataattaaagattagtgttaaagtttgtttaggatgagaattttattaagggaaatagttttgggattgttgtgtttatttggaaggtagttagtttataattgagtttttaaaaatgtatgtttttttatatgaaaatatatttgaatgggattttgtagaaagtattttttattaaggtatagtttgaggggaggtttttgttttatttttggttgtgttgtttttagttaagggtagtagggattagagtggtttttggggtatagtattggttgtttttaaagagtgttttgtttagtttatgaaaagtttgtgttttgtgagtttgggagggtgttattatttttagttttttagggagtattatttttaaatttatgtttttttgtttagtttttagattttttgttggttatttatttgggttttggttagattatttataaagtgaaggttgaatttgaggttttttgaggtttttgttagttaggtgggtggagtgatgtttttttggggttggtggtttaggaggtaggggatttattgtggtttgtttaggttgtttggtggggtggttattttgaggatggttttattgtgtaagtttgatgaaggttttttttagtgttttttgttttgtggtttttgttgggtggagagtaggatgttgggttttatatttatttgttttagtgggtttgagtttttgagtttaaatagataagatgtagttttattgttatttaagttttttgttgttttttttggtttttttttgaggtttgtttgttgtgtttgattgggtgtgtttagtggtataatatatatttgttttattagttttaatgtgataattaagatgtggttttgaggttgggtgttgtggtttatgtttgtaattttagtattttgggaggttgaggtgggtggattatgagattaggagattgagattattttggttgatatggtgaaattttatttttattaaaaatataaaaaaatatggtgggtgtttatagttttagttgtttgggaggttgaggtaggagaatggtatgaattagggaggtggagtttgtagtgagttgagattgtgttattgtattttagtttgggtaatagagttagattttgttttaaagaaaaaaaaaaaaaaagatgtggttttgggagtagtggtggaggggattatatgttttagagaggagttattgagatgggttttttttttttaggttttttagggattttttaatatatatatagtggtaattaatagattagggtttaaggtatgtaggggttgatatttttagtgattttttgttttatggtttgtaggttattttagaatatttaaagtttggagtttggtttagttattttatgttttttagtgttgggtttagagggtggtatgagtggtagaaattgttattattgttaattattgatgatggtgttggttatgtgagatggtagttatggtattgtatgtgagtgaagggattaaggaggttgggtttgggagggagggtttggaaagttggggtgaattaaaggtaggggagttttttttttttttatttgtttgtttatgttttgatgggtttgtgtttgtggtaagggggttgttagtgtgaatggatatatgtatatatatgtatatatatgtgtatatatatgttaggtttttttgagtgttgggagtttttttttttataattaattgttaggaaggtatagaaatgttattttaggtaggagattgaggtagttttgaagatagattttggttggaagtaaaaaataaattatatagtggataaattaattattagttaggtttaagtgttgttgttttagatttgagttaggggggtaggttttttatatttttttaaggttttggtgttaatagttttagtattgatagtggttatgatatgtaagaatggtatattggaaaatgaaagggaagtagttaggagagaggagagttgagtttaaataaaagttagatttaggagagtttagtttttgagatggagtttattttatgagtttggaattgttaaaaagaaaagaaatatttttgtgaaaaatgagtaaaagtgttttttgtatgtttatttttttaggtataaataaagttttgagtttagggtagtggggggtggttgatggggagggggttgtttgtgtatttgagatttggtttttttttatttttatggatatatttagtagtggtgggagttttggtgttttgtttagaggtggtttttttttttttatttttgttgtttttttttttttagttttttttttttttttttttttttttaaaaatattttttgtttggtttaatttttttaatttgttgtaattatgaatgtatttgaattattatatttttatgtgttgattatatgtttgtgttttaaattgaagtagtattgtttttttaaaatgggaggaaaaagggagtaaaggagagaaatttaaaaataggaggtaggagagagggtttgaagtgggttttgaggagtttggtagattattgggtttgtttgtgagagttttagagttttggttgtttggtttggttggtggttgtagaggttttgagtgtggtttttggtagttttttttttttattttttttagtttttgttgttttgaggtttgttgtttttttttaatatttatttggagatgtttaatttagatttttggaaattaatttatagagttaaatttttgatgatttttaaagttttttattttttttgttttgtgatgttatgatttttttgggtttaagggtttaaaaagtttagtttttgtgtgtttgttttgtttttttttgttttgggttggttttagtttttttttattttgtattttaatgtggttgggtaggaggaatggttgtgttttaggttagtgtgttgagaaaaggttttggagtatttgtttaggaggaattttgagaagttatttttttttgttttattagtttgtagtgatagaggtagttgttgtttttgtttaggtagagagggtgaatgggatggggattttttggaagatttttattatatatgtatgagttagtgagtttttagttgttttttgggagggagtgagtttttttttttgggaatttggggttttattgggggattagtgttgttttttattgtttatttggggtttttagaggttgtttatttatttggggggtttttattagtatatggttagggtttatgttgaggttaagggtttagtagagtaggtgggggtttataatgtgggtttttggggtgggaattaggggtattttttttgtttttaagttttattttaagggtttatttaaatttgagatatggaggttggttttgttggtttaagtttgtttaaagagaatgtgtgtttgtgttaaggttgagaatttaggtaatttttttgaaaattttagattgttagtttttgttgagaaagggaggatgtgtggttgtattatggaagtttttttgtttggttgtatagggttggtataagatagttttgttttttagataaaatattttttagtttgtgttgttttttaaggtttttaataaatttataatatttgtatttttttattttgatatattttgtaggtttttgagtttataatttttgttttatagagttaggtgagttatttgtgattaggtgaggtttatgtatagtttttggttagatgatagagttaaaggttttgaagtgttattttaggttatagttttgtttgttttttgtttgggataggattttaaatgtaatttttttggtagaaaggatatttttttggggggtggggaggattatttttagttttttgggagatattaagtaattatttttttttaaagagtttggaggatagttttataggtagttagatagtgagggaggtggggatagtattttagttgaggtgggaggttggggaggaagggagggattatagttatgagagaaggttgaataatggttttagggatagtatgttttaatttttagatttgtaaatgggattttgtttggaataagagtttttgtatttgtgatttagttgtagattttgttgtggtgagagtattttggatggtttaggtggtttttaaaggtagttttggtgtttatataagatgggggtagagggagatttgatatagatagggatggttaagtggagatggggtttggagagatttgtagatgttggtgttgaaggtaagggttatgtagttataagttaagggatatttatagttattagaggtttaaaggggtaggtgatgaaggtagtggtttttaatttttttggtatttgggattggttttagggaagataatttttttatagattagggagtggggagatggttttgagatgatttaagtgtattatatttattattttattttattttattttattgagatagagttttgttttgttatttaggttggagtatagtggtattattttagtttattgtaatttttgttatttgggtttaagtaatttttttgttttagttttttaagaagttgggattatagatgtttgttattgtgtttggttaatttttgtatttttagtagaaatggggttttattatattggttaggttgattttgaatttttgattttgtgatttgttagttttggttttttaaagtgttgggattataggtataagttattgtgtttggtttttattttttattttttgagatagagttttattttgggattataggtgtgagttattgtatttggttataagtatgttgtattgattgtgtattttatttttattattattataatatataatgagataattatataatttattataatgtagaattagttggagttttgagtttatttttttgtaattagatggttttatttggtggtgatgggagatggtgatagattattaggtattagatttttataagaagtatgtaatttagattttttatatgtgttgtttataatatggtttatttttttataagaatttaatgttatggttgattagataggaggtagagtttgggtagtaatgtgagtaatggggagtgattgtaaatatagatgaagttttgtttgtttgttagttatttattttttgttgtgtaggttagtttttaataggatatatggggttgggaatttttgttttagagtttttagagggttatgtttagtggatattttgattttagtttggtgattttgattttggatgtgtggtttgtagagttgtgagaggatggttgggtgttgttgtgatttagttagtttgtggttatttgttatagtagttgtaggaaattgatgtagtgttatagatggagttagggtttagtttattggagttgttttttgttattttatttttttttaaaatattgtgttaagttaattattaataattattgattttgatgggtaggaattgtagaggttttttggtttgtttttttaattttttttttaattttgaaataatattttttgttggtttttttgattataaatgtaatatttttttttgtattgagtttagaaataagagaaaaagtaaaaagtagaaattttagttgggtaaggtggtatgtgtttgtaattttagtattttgggaggttgtggtggaaggattgtttgaagttaggagtttgaggttgttgtgagttataattgtattattgtattttggttgggtaaaaagagtgagattttgttttaaattaaaaaaaaaaaaaaagaagaggaagaaaatttattaattttatttgagattttttatatgaatttttgttgtggggtagggaagtttaggaaggttttatgaggttttgatttagtttggttggtggtgggaatttgggaatagttttgagtgaggggttgggttatgattgagtttatttatttagttattttttgtatgttgtgtatattatgggtttgatggttagggttggagtatttgttgagtatagttttgatttttagttttatttagtatggtttggtttgaggtttattttttttttgtgtttgaaaatttaaatattttggtttaggtgggggattatttgaaatggaaaatttggtagtattgattggttttgaagaggtaggagttagttatgagttggttgggaggtgagtgtagaggtggtgaggtaaggttagtagagggtgggggaggtgagggttaattttttattgtgtatggtgtaagtattaagggggtattttattaggttagtgtagatttaggtttttgtggtggattttttgtggtttttttttttagaggaatattgaagaggtttttgtggttttgttttagatttagaggtatatttgtatattaaatgtattgagtaattttatagtgagggagttgggtttggtttaatttatttttttttaaattggattaaaggttgttgttttaggaaggtagggtttttaggtttatggttttgggaaattttggttgtgttagtttatgagtttagtttttagttattttagtttgtttatattttggagtgggtattgttatttaaaagttttttttagatagtttttagggtggtatttttgttttttattttttatagatttttggttatttttttgtgatattagtattattggtttatagttttttttaattgtaaagtggggtttagtggtataggttgggtttggtagggtgggaaggaagagtgaaggttattttgtttttaatagtattggttgggttttggaaaggttggaatttatagataggaaggaagtgttatatttatttaatttgttttgtgttagttagggggtattttgtagaaagaagttaggtggttgtggttgggtgtagtggtttatgtttgtaattttagtattttgggaggttgaggtaggtggattataaggttaggggttttagattagtttgattaatatggtgaaattttgtttttattaaaaatataaaaattagttgggtatggtggtgtatgtttgtaattttagttatttagaaggttgaggtaggagaattgtttgaatttgggaggtggaggttgtagtgagtttagattatgttattgtattttagtttgggtgatagtgtgagattttattttaaaaaaaaaaaaaagaagttaggtggttattttttagtttttggtttggtttaggaattgttttttttttaagatgttattaaatgttttttttattaggaagttttttttggttgttttttttatttttgtttttgttttagaatatggtttggtttttatggataattttgatattagagtttaatagagatttttttttttatggaaatttatattttaaattgaatatgtgtgtaggataagtttttgtttttatgtgaaataaaagtgaaaggtgtggattatttgtttttttttatttttttttataataatttgggttttataggggtttagtaggagttaggtttagtttagttgttttaggtgtattattttgggtattagtgtttttgtttttttttatgaagtatagttttattttttggtatttagtggggaggggatatatattaggtattttttagggtggattgtgttttttatattaggttaggaggttttggggttggtttagttatttagaaaagggagtaggtggtttaggtgatattgatgtgggtagtaggggtttttgggaaagggtttttgtaggattggttttattttgttttaggagtatatattggggaagggtgttgtgtggaggtggagagaatgtatttttggttgaaagtatgttttttgatgttttgggtttggatttgttgttattttttatgtttttttatttaatatatgttttagtaaattttttatgttgatgagtgttaagttatagaggatgtataattttttgttttaaaaagtgattttttttgttgggtgtggtggtttatatttgtaattttaatattttgggaggttaaagtgggaggattatttgaggttaagagtttaagattagtttgggtaatatagagaaattttatttttataaaaaaaaaaaaaaaaaaaaaaagtttaggtatagtggtttatgtttgtaattttagttatttgggaggttgaggtaggagaattatttgaatttgggaggtagagattgtagtgagttaagattatgttattgtattttagtttgggtaatagagtaagattttattttaaaaaaaaaaaaaatttttttttttgaaatagggttttattttttttgtttaggttggaggatagtgatgtgattataatttattgtagttttagttttttgggtagttggaattatagggttgtattattatgtttagttaattttttgtatttttagttaagatggggttttgttatgttgtttaggttggtttggagtatttgagtttaagtgatttttttattttggttttaaaagtattgggattataggtatgggttattatgtttagtttgaaaatattttttttaagaattagttagttatggtggtgtataattgtagttttagttatttaggaggttaaggtaggaggattttttgagtttggtaggttgaggttgtagtgagttataattgtgttattgtattttagtttgggggatagagaaagattttgtttagaaagaaaaaagaaaaaaaaaagatttttttatttattttttgtttatttttagatttaattattgaagtttgtttttttgaattaaaaatgaaggagttttgttttggatttttttttgttgattttgttattgtatttgttagtagagttagttaagattttttaggttggttttagtttggtttgtttatagttttttaagtaagatggatttttaggttgaggttagttgtatttttttttggaatttttttttattttttattgtgttttagattttggttgtttttaaataaatataatttagttatttttgtttttggggttgttgtagggtttattggtgtaaattgtttgggtaggtttgttgttttaggagtttttttaggttagtgtggaaggaaattaagataatggggagaagtagtttggttgggtttaattttatttttatatgtttgtgtttagttaattatttgggttgtagtttgataggagttggagttggtgttttatttttagagggggtttttgattgtttttgtagagtgagggaggtttgggggtgtagaggttaagggtttttgtagagtttgttttaggttttttgagtttaagtttttttgtagttaatggaagatttttttgagagtgggtgttttttattttgtttgtttagtaggtgtttagtaattgtttattggataaataatgaatttgtggatttaatgtgaagatgatttaaattagtgtttttttatagaattttttgtaatgatgttaatgttttgtatttgttgtagttaatatggtagttatatgtggtagtgaatgtttgtaatgtggaagggttattaaggtaaagagttttgtatttatgttataatttaaatttaaatagttataaatgtttagtgtgtgttttgttatatagattttttttgttattttttttttttttttagagatattgtatttgttattaattttttatttgggaggtaaatggagaaatgttattttttagttaatgtaaaagaaggttaatatttgtattttaagttagttttttgggtaatttttttaagtattttttattaaggttagtttagtaatattttttgattgtttgttatgtattaggaaagtattttgttgtggttttggtttgaggttatggaggatatagaaataattaaggttaagttgatagaaggggtgtgataagatggtttaaagttattgagttagttaggaggtttaggagtatggaagttttgttttttagaggataagtggtaatttatttagggggggtttgagtatttagagttaggagtgtagaagtagggggttttaggttggaaagtggtattagggttaggttgggtggtagtatgaatttatttttgaggttttgggggtggaaattaagggttttatgagtaagaagatttggtttaggtttaatggaaatgattgggtggagggattttattatttggtttttagtatatagggagggaagtggtaattgttttttaaatgttggttgtggaggggaaggagttatagtagggtaggggtggggaggatggtatttgttggtttaaggagggatgatggaggtttaattaagatatgattgtgattggggtagtttgtttaagggttagtatgtagagggtgagttgatgagattttggtagtttgttgagatttgggggtgttggggaggtagaggttaaggttaattttgagattttttgtttgtaaatttgggtgggtggtaaggttgatattagagaaatagaggaagagtgggtagttatgggtgagagaggaagtaatgaattaggggtgtttgtaagagtttaggggtaaggtttttgggtagttaagatgttggtggttttttttatgattagttttttttatgtggtatatttttgtttgtatggttgggtatggggtatttgtttgtttgatatattttgagtagttattttgtgtattgaggtaatgtggtatggtgttttggggaaatagtgaggaggtattgtataggttttatttttttggtattttttgttttttggggatggtggtagttaaataagtgatagttaattgttaggagagtttggttttgatttattaggtggagttaggtatttttgttggaagaggtatgggaattagtataggatgaagggaggtagtgagtattagtttaggttttgtttttatagggttttttttttatatttatttgtgtaggtgttttttgtgagggtagagatatttgtagtgtttgagggagattttttgtgggtggggttgtttatttatagtggttaggtgggaggtgtattagtgttttgtggttgttataatggattatagttgtggggtttgaaaaaatggaagtgggtttttttttatgttggaggttagaggtttaaaattaaggtgttagtaaggttatattttttagggaggttttggggtggggtggggggggggtttttttttgtttttttttagatgttttttggtttggggttgtgttattttattatttgtttttgtttttatgtggttttttttggtgtgtttgtggtttttttgttttttttaaggatattagttgttggatttagggtttattttaatttagaatgattttattttaagatttttaattatttatatttgtaaagattttatttttaatttttaggttatattttgaggtttttggtggatatgagtttgtgggggatatggtttaatttaggatagaagggatgatgggggtattggggaaaaggttatatattttagaggtattggaagatggaagagtaggatttagtgatatgggatgttaggtagaggagttggttttaaggattttagttggggtttgagggttagagggagggaagtttaggtattattgagatgaaatgttttgtgtattgtgggaaatagggtaaaagtttgttggatgtttagttagagaggtggttgtttgaggtatagaaaatgagtgaatatgggagagtttattagaaggttatttgggagggtgtggtggtaatatttagaagggttgagaagtgtatttttatagtttagttaaatttatttggggaaatatatgtttttggtagtattagtaatagagaagatttttggtgatgttattagtgggttatgggatgggtaaattttgtttttttatatagaggaatatttgttagttgttaaaataagtgaattaaggttttgtggatttatatggataagtttttatgttgttatgttgtgggtataggtagggtagttattgattttagtgaggtattaaggatgtgatgttgatgatggtatttaagaggagatagatttaggttgtttagttatatgatgttgatgattgtatgtaagaggagattaggttggatgtggtggtttatatttataattttagtattttgggaggttaaggtaggtggattatttgaggttaggggtatgagattagtttgattaatatggtgaaattttgtgtttattaaaaatataaaaaaaattagttagatatggtggtgggtgtttgtaattttggttattgaggaggttgaggtagaagaattgtttgaatttaggaggtagaggttgtagtgagttgagatggtgttattgtattttagtttgggtgatagagtgagattttattttaaaaaaaaaaaaaaggagatttaggttttttagatatattattgtttagtatagatgtgtttgtttggggttagattttaatttagaggggtgggtattgtagtaggagtggggttaggatggagaaggttatttagggttgtggttatatttgtaatgttttattttttaagtgggatggtgagtatataggtgttttattattttattttttatatttttgttttgtagttttaagaattttattttttttttaaaaggaaagaaagtgtgtgagttgattaaagtgttgattatggtgttatttaagtttttgttagaaatgttatttttggtttagttttaaatataattttgagaagagtttttgtttttttggggagggtaagagttttagatataggagattggttagatgtggatttatagagaagttgggttgggaggatgggatggtagatagttgtttggggagtgttaaatggggaggttggagatgttggggtgtttaggaatgaatttttgtttggattagggttttagtaaaagggaggtagggagaaagaaagaagttaagaagatgaggaaagggtgttttgggttagagtttatagaggtttatagagggaggattttgtgtgttagtaggtagttttatgtaaatttagattattagtttgtagttttgggatttagtaaattatgttttaggtttttaagttgagttgtgattgtggttgttaagtgttgatagtatagaattagttagtttgagtagagggaagtaattgttgggggaggttgtgtttatgtagtttagggtgttaggtttttaagatgtaatttttataagaattgggggattttttttatttattttattagaagttggttaatgagagggaaggagatggagaggtagattagatgtggagttggagaaaagttttttagaaatatagtagtggttgggttgtttagtggttagtgtttaatatgattgtgatgggtggagttttttttaattatagtgttgaattatgtagttgtttaggggtttttagttagagtattatttttttttttttatatatagttttattttgtattgtaaggggttttatatgtatttaatgtggatatggtattttttttatttttattttttgtaaaaagttattttttttattgtttaggtttggtggtgtatagtttatgggtattgtatttatttttggaaggtagatttaggaggtgtttgtgttgtttttatagaagtaagtttaggattagaagtaggttttgggtttagaattttgaggttttaggtgttagtgtggtttggaattgtttagttttatagttattagttatatgtagatataagtggaaatttatttaaaataaataaataattttatgtaagtaaatgagtgaataaagtaaatgtaaatatttatattttgagtgtgtaatagatttaggtggttaagtggttattatataggatggtggagtgtagatgtatagaatagatttattattatagaaggttttattagatggagttggtttagagtatggaggtggtggttttagatgggtatatgtttttgtttttgtaggtgttttgttttggtaggatggttgttttattttgttttgaaggtagttttggtttataggtgttttatttgtgtggatttgattttgggtttgtgttttttggtaattttgttttttttagaatggttaatttatgaaggtatagtttttgtttgtttgttattatgatggtagttaggggtttggtatttagttggtttttagtatatatgtataggtgattatgttatttttgttttttttagagttttttgttttttaggggaggtaagtttatttattgttgtgatttattattttttttaaatagaaaagttattagatgggtatttgttttagtttggttgttggaagtgatagttaagaataatgtaggtttttagaaatagaggtattagtatggttatattggggttaggtaggggagattagggatatttagtggggagaagatgatgtgtagatttagttttggggggtaagggttggaggtagagttttgatttttttgttttatttttttgtttaggttgtatttagtgttggtagagtttttttaagtttataagttgtaatttgtgttttggatggttagttttagagttttgatgggtgtatttgttttttttttttattggttagtgtggaaaatttttaaatatatggaaaaagtataaggagtagtatagtgattattgttagaggtttatttatttttttttagataatattggatgtatttgttttattttggagtattttttattttgtaaggttgtagggagtttatagatattgaattaatattgagaggtttatggttaaagttatttgtttatggtatatttgtttttttagtattttaaattaaattatttagttttatttattttttgtttttttttttgttttgtatatatgggtttgttttttgagtttgggggtggttgtttttgtttttataaggattatttttagtagggtagtgttgataggtttggaagttatttgagtttaaagttgttaaagattgtgtttttttgggaaatgggtaagtggttttatttatttagggaagttaggtggggaggtaggttttagattagaatgaagggattttagtataaatatatttatgagttgggtggggttagagtggagtgagttatttatttgggttattggagttattaagtttttggagttggttattggaggtttgtgtgttttttaaagatagagataaagggtaaaggttatataaggttattggtgttttttttttgggtggatgattaatattaggaatgtttttgtttttgtttttgttgtgagttttagagttagaaatggggtttatttggggatagaggttttatttttttaggtaattttggatgttggagggatgatagttattgttgtttggttgttggaggggttttgggttaaatttttatatatatttttttttaagttttattatttttgttttgtagataaggaatttgagtttttatagagtgttatttttttgtggttatatagtgaatgagagttgtatataggtgagtttatgtttattagattttaagttgggttgtatttaagtgtgtttttgttggatggagtttttttttttttttatgtttatttgttttatgaattagggtttttttatattagggtttataatttatgggtagttttgatttagttttttttatttttagggttgggtgtagttgggttggatttggggatggagtgggataggttatttttattttttgttttaggagggaataaaaatagaattttagattaatgtagttttttgtggtatgtgttttttttgtttatatataggttttggtttggggttgtttgttggagaggtttatggtaggtaagttttaatttgaggagatttgttgaggtgttaagttaagtaaatttgaaaggttgttaggaggagtggttttgggagtataggtggttattttattgttgtagagtatggtattttggggatgttttttgggtaatgttatatagttattttttagagagttttagggatatataattagtttagttttattaatagtgagataagggattaggtagatttagatatttttttgtatttgattattatgttggttgttggttaaagatgttagtttttttttggaattttttagaaaggtttttgtagtatttatttatttatttatttatttatttattttatttatttatttatttatttatttatttatggattttatttattttattatttttttatatatttatttatttatttatttaatttatttatttagttttttatttatttatttatttattaatttatttatttgtttatttaatttatttatttattaatttatttatttattatttatttatttatttatttatttatttatttttttatttatttatttatttttttttttatttattttataattttatttttaaattgtgattagatggaaatgggtgtagttagtttgtttttaaaggtttagagtggaggtagagtgaattgtttatttggtttttgtgtttagtagtttaggtttgtatatatgttttataattataggatattagatttagtaattggtagtagaatgagtatagtgtattttttgtggaattagtattgatagggtatttatttttattaagtttgagtttttttggtgttggagggaatttttagatgggttttaattttagttgaatttattttttagggaaagtaatattgtgagaaatgtgtgtgatataaggttttaaagagggtgtgggttgtgatttttggagtaattagggaggttttatggaggagatgaggataaagttgagttttgaaggagggattggaggatgttgagtagggatatttatttttgtttgtgagggtttgatggtaggttgtgagttgtattttagttttgatttatttaatttataattttagtaggtaggtgtttttgttttattttatagaggaggaagtgaggtttagggttgggtaaattgtttaaggttgtatagttgtggaatttatttttagtatttttagtttgttttagttatgtttgtgattttatttagtattttttttttggtgtttatttattttgtttattgttaagtaataaaaattttattaggaaaatttaggggtttttggttagtttttttagatagaaaggtagattttggtgtagatttttaggaagtaaggatggaagggttagtatttgttttttagaaatgatagtttttttaagattaggagagatggtttagagtgtagttttggtgggttgtttaggattaggaggggagaggagtggggaggaggatgaattttatttttaaggttgttgagtggtatatagtgagtttggattttttagttttagttgagtttatttttatgatggttatgagtattttttttatatatttgattggaagttgtattgtatataatgtatatggggttattattttttgttttatatatttttatgtatatattattagtgtattattgggatattttgttgtttggggttgagagtgaattagaattttgtttataaatttagtatattttattgtggaaataatggggggtaaggaggggttgtttagtaaagaataggatatatgtttttgaggatggagttatttttggttgagatatttttgtaggggatgttggtgataaaggttgttttatttttttttttgggttagatggatattatttttgttttttgttttttagtattaggtaaaaggaaaatagaagaggttttatttaggttaaatattttagggttttttatttgtaggaaatatgttggtttattttttttaaatttagtatgggggtggagaaatggtggggaaaatagtatttgttttagattttttgggtggagtttttgttttatttatattgtttatttttttgattttttaaaatgggtatttggtgtttggtagtttttggtatagagaagatgtaaagtaaattgtttataagaagggggtgagtgtagtttgagtattttttgtttttgaataaattgttaggtttagtgtagttgttgttgttattgttgtttttaggaagggatttttggttatgagtggttttagtttagttttttggatttaattatttaggtttgtgtttgagtttagtaaagaggtagttagaaaagtttttaagatatttaatgattttgtggttttagttgagaagtgagttatttttatgtgattttaaaataaaatatatttagaaggagagaagataattgaaatttagttgtttggagttattttagatgaaagtatttgagtttttgggaggtaaaggaggtaggaaagtttggagttagatgattagaatttgaatgtagattttgttaggtttttgttgtgggttttgggagatgatttttattttttgagttttagtttttttggggatagagatggtgtttatttataggttgttttgagttaatgaggttatatggtgtaagtattagtatagtgtttggtataaaattaaaatttaataagtgatattattattattattattattattattatttttgagatggagttttgttttgttatttaggttggattgtagtggtatgattttagtttattgtaatttttgttttttaagtagttgagattataggtatttgttattatgttttggttaatttttgtatatttggtagagatagggttttattatgttggttaggttggttttgaattgattttaggtgatttgtttgttttagttttttaaagtgtttggattataggtgttagttattgttatttggttgtgatattattataatattaatattataatagttggttaggtatggtgatttatgtttgtaattttagtaatttgggaggttgatgtgggttagttatttgaggttagtttgagattagtttgattaatatagggaaattttatttttattaaaaatataaaaattagttgggtgtggtggtatttgtttgtaattttagttatttgggaggttaaggtaggagaattgtttgaatttaggagatggaggttgtagtgagttgagattatattattgtattttagtttgggtgatagagtaagattttgttttaaaaaataataataataaataaataaaatatattttgatgagatatggtaaaagatagtagaaggtaggagtttggggatttattatgggttggtgttttaagtagaaagaaatgtagtgtttataagttagagagtagatgttgaagataggagatgagtggggttttttggttttggagaggaaagggtgagtttaggtagaaagagtaaatttagggtgttttgtgtagtgttttttttgtggaattagtttagggtattagtagtatagtttttttttagtagtggagattaggttaattgtttagtgttttttttgtttttttgttttaattttattaagtatagtttttttttgggtatagtagttttgtaggggtggatattgatttatgtatttaggagtttagaggtttttttttttttatttatttatttagagatggagtttttttttgttgtttaggttggagtgtagtggtattaatttggtttattgtaatttttattttttaggtttaagtgatttttttgttttaattttttgtgtagttgggattataagtatgtattattatgtttggttaatttttgtatttttagtagagatggggttttattatgttggttaggttggttttgaatttttgattttgtgatttttttattttggttttttaaagtgttgggattatagatgtgagttattatgtttggttaggggttttttttaatggattttttttaatgtatataatttggggaatttagatataagaaagatatagagtatgaaggttttttattggtttgtttatttttagaggtggggttttaggtggtttaggttggttttaaatttttggttttaagtaatttttttgttttggttttatgttgggattataggtataagttattatgtttagttatttttttttttatttgggttgttatgttagaatttggtaagttataagatggaaatgtttaaataggtatttagaatttgagtagatattatttgatgtattattgttgttattttaatgattgaaatgtatttattatatttgtttttttaaaggttattttagatttttatagattttatttgtgatgtaagatagttattttaaatttttttgtgggtttgaatagattagatttttgaatttttgggtagagtagggatggggttgttttagaggagggtgatattgttatatttttgttttgtttttgtgttgataatgaatgaggtttggatagttttttttttattaaaagttatatttttttaaaaaggagttttttaggatgaggtgttatgataatttaattgtgtataaatatttatttttaataatgatagaagttatttatagaaaagaatttatttttggttgggtatggtggtttaggtttgtaattttagtattttgagaggttaaggtaggtaaattatttgaggtttggagtttgagattagtttgattaatatggtgaaattttgtttttaatgaaaatataaaattagtttgtatgtttgtaattttagttatttaggaagttgaggtagaagaagtatttgagtttgagaggtggaggttgtagtgagttgagattgtgttattgtattttagtttgggtgatagagtgaaatttttttttaaaatatatatatatatatatatatatatatatatatatatatatataaatttatttttatttttttttttgaaatttttgagagaggttaggtgtagtggtttatatttgtaattttagtagtttgggaggttgaggtgggaggatggtttgaggttaggagttggagattagtttgggtaatatagtaagattttatttttattaaaaaataataaaagtttaaaaagtttttgagatagtttttggggaaaggtgggttatggagatttttattttggttatttgtgttttttttgtttgtttttttgtggtttttttttattttgagtttggggtgggggtggtttgagtttaggatgggggtggtttgagtttggggtgggagtggtttgagtttgggatagggtggtttgagttggggtgggggtgttttaagtttgggttgtgggtattttgagtttggggtggggatgttttgagtttggggtgggggtgttttgagtttgggttgagggtggtttgagtttgtgttgggggtggtttgagttgggatgggggtggtttgagttgggatgggggtggtttgagtttggggtgggggtgttttgagtttgggatgggggtattttgagtttgggatgggggtgttttgagttgggatgggggtgttttgagtttgggatgggggtggtttgagttgggatgggggtggtttgagtttggggtgggggtggtttgagtttggggtgggggtgtttaggatgtataggttttattttttttttttgaggtttagtttgtttataggagttgtgaagggttggattaaagttaaaggtttaaattttagatttatttttagatttagtggataattaaaatatttaagtttatttttaaaggaagttgagataaggagataatggttattttttttttttttttttttttgtttttggtttttgttatttggagttgtgttttgaagaggtatattgggtattaggtttttttggttttgtttttattttttgtttagatatagaataatttttttttatttttaaggttgatatgtggggttgtggattaaagttaatttatttatttatgaggggagtaatttttttgttttaggaatttgtttttataggagaataaatattgtagaaggtattgtttttagtggtggtgtatgtttgtaattttagttatttaggaggttgaggtagaagaattgttagaatttaggaggtggaggttgtagtgagttaatattatgttattgtattttaatttgggtgaaaagattaagattttgttttaaaataaaaaaagaatagtattttgtgttaaggttaggggttttagttattttttttgtgaagtggaaggggtattattagtttttgtgagaaggaaatagtttatttaattataaaatgttaattaaaggaggtagtatattggttttggtgtggtgttgttggtttttgtttggggtaggaggagggttgggggagagttaaaagttaaagaaggtttatggaggttgttttttttttggtgattagttttttttttgatggtaagttgttaatagtatttggtttttaggttggggaaggtgagattagtttatatttgtttagggttttgttttgtttgtatgggtagtaggtgtttattttgttagatggttttgtttattatagggtattagtgttagttaaggatttatagagtttttttgtaaaggtttattagtgggtattgggattttgggttttatttatatagggtttttatataaaatataggatgtttagttaaatttggattttagataaataattaataattttttgaagagataaggattttgttgttttatttaagttggagtttagtggtatgattatggtttattgtaattttgaatttttggatttaagtaattttttaattgtagttttttaaagtattgggattgtaggtatgagttattaaggttagtaaataatgaattatttttaggtataagtatattttaagtttgttgtgggatatgtttatattaaaaattaatttttgtttatttgaaatttaaattgaatttattgttgggggagataatggagtgatggattgatagaggagtatagagatagtttttttaaatttttagttgattaaagtttggtttttagtttttttgggtttttagagatgtattaagggtggaagtgattaggagggagataaaaatattgaagtttgagtgttagtattgagttgtgtggttttggataggattgttttttttttgagttttagttttatatgttataattggttaataatagttataaagtatttgaagttaatggttgggagtttgttttaggaggtaggtattattaggatgtagagagagtgaggagtttttaaagttagtttaggttaggtatagtagtttatgtttgtaattttagtattttgagaggttgaggtgagagaattatttgagtttagaagtttaaggttgtagtgagttgtaattgtattgttgtattttaggttgaatgatagagtttttgtttttaaaataaaataaaataaaataaaataaaataataaagttagtttgtgtattggattgtatgttgttttaaagtatttaaagtgagagaggttaggaagtaatgagatgtagaaaggtagggggaggaggtttagaggtattagagaagatagttgatttttatttttatatatttttggggtattttgagttttatttatatatttaggtgagaatttttgtatttgtgaaagtaatttgaggttgagagaattaataggaaattgttttattttttatgtagggtttttttataaataaggttgagttgtagtttattattgtagttgagttttttgtagtagttgtggtggggaaggttttttaggaggtttgagtaatttagaaatatttatagtatattttttagtttttttagaggtttttgttgagatgaaagtgttttggtttgtggttaaagagtttagtatattgggtagttatagtttttattatattgatttggttattaggtttttatgaatttagtgaggggagatgggttttttagggaagtttgttgatttttttatattgttgtaaatgtaaagtttggtgattttattatttttagtaattgtgatgtagtaataataagaatagttatgtttattgtttattgaaggtatatgatgagttagatattgtgttggtatatgtgatttttggaggtaatatatttttttttaaggaggaaatgattgagttttggagggagggttttttatttggttttaggtttttttttgatttgtgtttttttttttttttttgtttgttttattgtagtttttttggtttttttgttgtttttggaatgtattaagtttgtttttagtttagtttttgtattgttggtttttttttgtttttttaattttaatttagttgttattatttttgtgattttttattatttattttaaagtagttattagttattttttatgtaattattttattttaatttttattatagtttttagttttattttgatagtttttagaattgatgaatttattgattttgtttttttttattgtatgtaaattttaagaaataagagtttttgtttgtttattgttgtgttttagtgtttgttatagtatttggtatgtagtaggtgtttaatgaatatatttttaaaagaatgaatgattggaaggagtttgaaagaatgatggtttgtgttaatagtttatttttaatttttttagatgggatggagattattattatgtaattatgatttttttgagtttgtgtggtggttgatggtaggtgttagtttggttggattaagggatggttggtaatgtattgtttttgggtgtgtttgtgagggtgtttttggaggagatgggtatgtgagttggtgggttgagtggtaaagatttttttttaatatggatgatattattttattgttagataataaaaaggtagagaaaaggtgaatttttttttttttttggaggtgggatgttttttttttttgtttttggatttagaatttttagttttttagtagttttttaggtttttaaatttttggttttaaattaagagttatattaatagttttttagttttgaggtttgtagatttggattgagttatgatattggtttttttgggtttttagtttgtggatggttttttgtggtatattttggtttttataatggtatgagttaatttttttaataaatttttttttatttatttattatttatttttttaattgtttatttgtttatttatttatttatttattatttattttttatttatttatttattatttatttaattaatgtatttatgtttgtttgtttattggttatttatatttatttattaattatttatttatttattatttatttgttatttatttagttatttatttatttatttatttattttttttttttttttgagatggagttttattttgttgtttaggttggagtgtagtggtgtgattttagtttattgtaatttttattttttaggtttaagtgatttttgtgttttagttttttgagtggttgggattatagatatgtattattatgtttagttaatttttttatttttagtagagatggggttttattttgttagttaggttggttttaaatttttggttttaagtgatttattggttttagtttattaatgtgttggttattataggtaagagttattgaatttaatttattatttgtttgtttgtttgtttgtttgtttgtgtttatttgtttgtttggttatttattatttatttatttatttgtttgtttgtttgtttgtttgtttgtgtttgtttgtttttatttttttgtttgtttgtttatttagttatttgtttgtttgtttgtttgtgtttgtttgtttttttttttttttgtttgtttgtttgtttatttagttatttatttatttatttattttttattggttgtttttttggagagttttggttgatgtagatggtgttttggtaagtttaggttgttatttagattattgtggagggagtgatttaaataatagatatgtattttttagtttgagaggtttaaagttttggattaaggtgttgttagggttagtttttggtgaggtttttttttttggtttgtatttatttttttgttgtgttttttgttattttttttttgtttataagtgaggggggaggagagatttttggtgtttttttttttttttataaggatattaattttattagattagggttttgttttatgattttatttaattttaattatttttttaaaagttttatttttaattatagttgtattgggagttagggttttaatgtaggaatttaaggggaagggtatagtttggtttataataaatgggaaattatgtttatgattaaattttttagaagatatggtttattagtgttgttaatgattgtaagtaaaggttagagaggaaaggggtttttgtggggtggggggtggtgggggtagttggtgttgggaataaggtttttttttttgtttaatagtagggaagtgaggttggttgtagatgttatttggggtgggaagagaggggagtttttgtttgtatattttgtgtgggttttggtttgatttttttttgtgttttttattttttgtgtttttttttgtgtgggagaaatgttgatttttgttggtttaggtgtttaggtttttaggtttgttggttttgggttgggtttaattaatgagaggtttgggaggaatttgggaggtggaagtaagggagggtgtgggagttttttattttttttgttttagatagtttttttagtaggagaggtggttttttgtgtagttttagtttttgttagagttttatttttgtttgggtttttagtaggtgattttggtttttggattttggttataggatttttttttttttatttttatttaggggtggtggtggtattttgttgttaatttttaggttatttttataatgttaagaattttttttttatttgtatggtttttttttaaggtattgagaagggttttaattatatgtttatagggttaaatattttttgtaaaatttataaaatggaaaatattttttttataattaattaatgtttttgtttatttttagttttgagtttttgtttgttatatttttttttgtgtgaggtggaaatggaggtttgttgttatgtgggggtttttgttaaggagaagttgaattggaaagatatttagtttggttttggttgggttatatttatgtagtttttatttatttttatgtatagtttagttattgtttgttattttggtgtggaaatggattttagtaatatttgttttatttattgttttaattttatttattgtgtagaattaaaaattataagatatgaatatattttgtggtgtttggtgttggaaaaatgtgtgtagtggagagaagtaagatttgaaatgtatgggtttagaagtaaatttgtggaaaattatttttattattagaggtgaagttgtaagtaaaggatttagtttttttaatgtggagttaaaatagaaaagtttttttggttagaaatatatgtataaatgttttatatgtagttagaaattttttttatttttttattttttttttgatgggaattatatttaaaaaaaaagaaaaaaataggatttattagaatttttgtgtattttgaataaaataattgtagtagtattattaattttatgttgattgttatttttgtatatattttaattattaaaaataaaaataaaatttgattaattaaggagatttatttgttttatttatttatttatttttgagatggagttttattttgttgtttaggttggagtgtaatggtatgattttggtttattgtaatttttgttttttgggtttaagttatttttttgttttagttttttaagtagttgggattataggtgtgtgttattatatttggttaattttttatgtttttggtagagatggggttttattatgttgattaggttggttttaaatttttgattttaagtgatttgtttattttaattttttatagtgttggaattataggtgtgagttattatgtttagtttatgtttttttttgttgttttttttttttttttgagatatggttttatttttttatttaggttggagtgtagtggtatgattatggtttattgtagttttgattttttgggtttaagtaatttttttattttagttttttaagtaattgggattataggtgtatgttattatgttttgttagtttttgtatttttagtagagatggggttttgttatgttgtttggattggttttgaatttttggttttaagtgatttatttgttttggttttttaaagtgttgggattataggtatgagttattgtgtttagtttgattagttttttgtttttgaaatagaaaatgatattataaagttattatattgaagaagtaatgttaaaaatgtgggagaaatagaattttggagatatgattgatagttgattggtatttttttgtatgtagtgatgtttgtgatatttaatagttgtttataatttataatttgttgttatttatttttttattttaaatgaattattgtatttatatttttagagggttgtataagtttatattattttgattttttgttgattgtttttttgttttttgtttggtttttattttttttattatttgtgtaattagttttttgtttttaagtttttttgttttaaatgtttaagtggattaggtattgtggtttttgtttgtaattttagtattttgggaggtttaggtaggaggattatataaatttaggagtataagattaatttgggtaatatagtaagattttgtttttatatatatataaaaaatataaaaattagtaaggtgtgatggtatatgtttgtagttttagtattttgggaggttgaggtaggaggattgtttgaggttgggagtttaggattagtttgggtaataaagtaagattttgtttttataaaaataaaagaaaaaattaggtaggtatatagtgtgtatttatagtttgagttatttgggaggttgagaagggaggattgtttgagtttaggagtttaaggttgttatgagttgtgattatattattgtattttagtttgtgtgatagagtgagattttgttttgggaaaaataaataaataaataaataaataaataaataaataaatgtttaagtggtttttattttttggttagattttattatatattttatgaataaattgtatgtatgagaaaggtgagtagatgaatagggtagggttagggggttaaggggaagattatagattatgtggagtgagattagtggttaaaaattgttaattatagttaggtttggtggtttatgaaggtaattttaatggttgggtttggtggtttatgtttgtaattttagtattttgggaggttgatgtgagtttattatttgaggttaagagtttgagattagtttggttaatgtagggaaattttgtttttattaaaaatattaaaattggttaggtatggtggtgggtgtttgtagttttagttatttgggaggttgaagtaggagaattggttgaatttgggaggtggaggttgtagtgagttgggattttattattgtattttagtttgggtgatagagtgagattttattttaaaaaatttaaaaaaaaaaaaataaaaaattgtagattttaataaggaagagttataggatgatattttaggatgtgggaaaaggttatgttagttttggattttttttgattaatgggtattttagttattaaaggggtagatgtgttttatttaatttttatttagttattagagtataatatagggatgtgttatagatagagatggagattaataggtagaggggtgatggggaggaagattgaggtaagaggaataaaatggggattgtagagggtaggtggtaggagtttgagggttttagaagaaattgttgtataagtaatgagttagtagggtgagtgatggttaggagaggtggtttaagaaaataaagagatatttttgggggtatagatgtgttttgaggggttgaggaagagatggggaaggggtggttttgtggatttttggtatgattgttgtggtgaaaaggaattaaagattttgataaggggatgattttttaaataaggaagttttgggtttttgtagggggattagtagattgagggtaaatggtattttgtttattaaagttttaataaaatgttaaggtaagaatatttgtttggttttgggggtaattttagaaatattagaaaagggatttattatgtgtaatttttttttaattatttggagaaatgtatggttatttaagatagagaaaggtagttaaagtaagtggaggttaggtatagtgatttatgtttgtatttttagtgttttgggaggttgaggtaggaggattgtttgaggttggaaatttagtattagtttaggtaataataaaataagattttgttgttataaaaataaaaataaaaattttttgagatggagttttattttttttgtttaggttggagtgttgtggtatgattttagtttattgtaatttttgttttttagatttaagtaatttttttgttttagttttttgagtagttgggattataggtatgtgttattatgtttagttaattttgtagttttagtagagatagggtttttttatgttggttaggttggttttgaatttttgatttttttggttttttaaagtgttaggattataggtatgagttattgtgtttggttgttataaaaattttttaaaaattagttaggtatgttaggtgtggtggtttttatttgtaattttagtattttgggaggttaaggtaggtggattatgaggttaggagtttgagattagtttgattaatatggtgaaattttgtttttattaaaaatataaaaattagttaggtgtggtggtatatgtttgtaattgtagttatttaggaggttgaggtaggagaattgttttaatttaggagttgggggttgtagtgagttgagattgtattatggtattttagtttgggtaatagagtaagattttgttttaaaaaaaaaaaaaaaaaaaaaattagttaggtatgtagtgtatatttgtagttttagttatttaggaggttgagaagggaggattaattgaaattgggaggttgagattgggaggttatgattatgttattgtattttaatttgggtaatatagtaagattttgtttaataataataataataaataatgtaagtgggtataagaatttatttatttatttatttatttatttatttatgagatagggttttattttgttgtttaggttggagtgtattggtgtaattttggtttattgtaagttttgttttttgggtttatgttatttttttgttttagttttttgagtagttgggattataggtgtttgttattgtatttagttaattttttgtatttttagtagagatggggttttattatggttttgattttttgattttgtgatttgtttgttttggttttttaaagtgttgggattataggtgtgagttattgtttttggttttaagaatttattttattttagtattttggaggttgaggtgagtggattatgaggttagaagattgagattattttggttaatatggtgaaattttgtttttattaaaaaaatataaaaaattagttgggtgtgggggtgggtgtttgtagttttagttatgtgggatgttgaggtaggagaatggtgtgaatttgggaggtggagtttgtagtgagtggagattgtgttattgtattttagtttgggtaatagagtgagattttattttaaaaaaaaaaaaaaaagaatttattttaagatagtaagttttagggttgaagttagtttttatttagttttaggtttaaagttataagtatggttattgtaatatttttatttaggatattattttttaggggtttagatttatattattaaggaggagtgtttatattagtagttggggagagggtggttttttataagatgtaatgtttattttgaagagttattatagtgataattatgaaatttatgtttgagatttaattttaagtgaaaagaatagaatttaatatttattttatggggagtataaaattttgaaaatatatgttttttataattaaattaaattttatgttatgtttttgaggagataagtattgaatggaatatagaagaaatgttatagttaatgattgttgaagttttttttttaattttttgtttatgttgtttggtaataagtaatatagaaaattgataataaaaagtaaaagagaaagaaaagatatagtgtatagtttagattgttttttttaaaaaattaaataataataataaaaagtataggttgggtgtggtggtttatgtttgtaattttagtattttgggaggttaaggtgggtggattatttgaggttgggagtttgagattagtttgattaatatggggatattttgtttgtattaaaaatataaaattagttgggtatggtgatgtaggtttgtaattttagttatttgggaggttgaggtaagagaattgtttgaatttgggaggtggaggttgtagtgagttgagattgtgtttttgtattttagtttgggtaataagagtgaaattttattttaaaaaaaaaaaaaaaaaagtataaatgtaagttgggtgtggtagtttatgtttgtaattttagtattttgggaggttggggtaggtggattatttgaggttaggagtttgaaattaatttggttaatatggtgaaattttatttttattaaaaatataaaaattagttaggtatggtggtgtgtgtttgtaattttagttatttaggaggttgaggtaggagaattgtttgaatttaggaggtagaggttgtagtgagttaagattgagttattatattttagtttgggtgatagagtgagattttgttttaaaaattaaattaaattaaattaaataaaataaaaaaaagaagtggtataatataaagttttggtagttaaagtgttaatttttagttattaggaaggttttgttatttaatgatttattgttttagttaaggttagttatattttgggtttttgatgttggaggtaatatgatgttaatattggtgagaaatttattatttttttttttttgttttttggtgttggtttttgtgtgtatttgtagtttttttattattggtgtttttatggtgtttatgttattggtttattttttagtaataatttgatagtttgatatttttgtagattttgtggttatagagttaaagttttttgttattagtgggttttgtagataattttttaaatttttttgggttgagttagttaagtttttaataagttggaagatgataggggttggatgtaatttatttttaattggtttgggttatatggatattattttttttttgggatttgatttgggatggaaataggagttatagtttatgggaaggttgtgaaaggaagttttggttttagggtgtggattaggttgatttgtggaataaggttttaggggtggtttatttgtttgttttgtttagttttttttggtaattatatttatttggggtttattttaaatttggtaggtaatgttgttgtttttattttagttgttgttttaatatgttttgtttggttaggataggtgtttaggtatggtatttagggatatttttggtttttggggtttaatttttggtttttaggtgtagtgttgggaaaagtagagggttttggttatggtgtaggttttgttataggttatttaagtagtttgggaggagttggaaagagagtaatgtatttatttggatagagattgaagttatatttttattgagaaaagatgatatttttgtttggattttttttttgaaattttaggttggggtggggtaggagttagtgagagagtttagtgttttaaaggggattttttggttttttgtgttttttaatttagtatttttggggatttatatatttagggtagagtggttatttagggttttttttatttagatataaaggttattgaaggttttgggttaatattgttttgaggatgattagtgatttgagtttttgttagagatagtaggtagtttgggtttaagggttgtttagtgatttgaagttgggattattttatattttttgtgttatttttgttttttgttttggaggtttttaggttgttaatagttatgttttggagaattaggttagattaggttgggaataaagtttagttgttatagagttgttgagaggttattggtaagtagtgtttaggagttgttttttttttgttagtaatagtttaatgtttttttttataggggttgtaaatgggtttatgtttagggtggggttagggagataaagtagagagaaattgggttgggagtagagagtgttatgttttattttggagatttaaggttaggttattttgtagagttggtgtttagagtttttagtgtataggagaggaggtaaatagaatttgatatttagtagtgtttggtagatgtttttggaatgaatgattaaatttatatggagagttgaaatgggttaggaattttagggagatgggtagtttatagtttagtagggttgttttagtagagtaggttaatgttaggttttttggtaaattttttggggtttaggtataattgttatattaggaaaggggtaggggtgattagtttattggttatgggggtattttattgtttttatagaagtttggtatttataggtttgggtgatatatgatttttatgtttggtattatgatggttgtttattaagtttttttatttattaggattgattttttttggttagtgattttagattattatgatttggtagttgttgttaggtttgtttggttaaggatttttttggagattgagttattttatatagtaaagtgagttatggggttatagtgttgtgtgttgtgtataagttttgagggttttatttagggattggtatttattgatttttataaatttttggtaattgtttagagttgggatgtttttaaggtaatagttttaataaatagaggtgtaggaatttagtgtgttattttttgttttattttaaaggtttatatttttaggggtttggagtttttttttggagttttttttattttaaagttagttggatttgtttaggaattgttattattattttttggttgggtttgtattgatgtgtattgaattttttttattaggtttattttaggtaaattttagagtttatgtaatattgtttgtggataaatattggggtggaaataggggttatttttaggttttagttatatggggttgttagggttgtttgggatggtaggagagtgttagaggagggtagtttaaggattaggtagggggtgggaagtgtttttttttatgggtttttaagtgagatgttttttgtaaatatttatttgggatttttaagtagagggttggtttttatgttatttggatttggattttagattattgtttttaagtggtaattttgggtttttttgtatttgttttggtttgagttggttatatttgtggggggtggttttaggaagaaggtggattgttgtaaatgtaatgttttgttgttaggtgtattgtttttggttattagaatttttttgggtaggttggggagatttgatgggtaagtgtttgtggtttggtgtgagtgggtagggtaggtggtttttgtttgggtatgtttttttatttttgtaatagattagggagagggttggttttaggatttaggtttagttagttgttttataattgaggggttttggtggaggatataagttagatagagttatagattaattgtatgaggtggttttttttttttagtttaggttttttgaatgtgttagagtagataagtttggatgtgaggaggtaagaggtagtgagaataggtgtggagatggggttgggggagaagaggaagaaattttgtgtttgtgttttttttatgtttgtttgttattgggttagttgattggggaagtgttttttgagggtgtaattttttgttttttttgtaagttagtttttggggtgttgggtgagggtgtagttttgtttattatggtgagttagtatattgaattatggtagaagttgttttttgtgtgggtgtagtttttttttttgtttaggatttagaagttatgatagtatagagttttttaattgtggttggtgtttttttaggaattttttgaaagttatagagaaattttagagtggttgggtatggtggtttatgtttgtgattttagtattttgggaggttgaggtgggtggattatttgaggtttggagtttgagattagtttggttagtatggtaaaattttatttttattaaaaaatataaaaattagttgggtatggtggtatatgtttgtaattttagttatttaggaggttgaggtatgagaattgtttgaatttgggaggtagaggttgtagtgaattgagattgtgttattgtattttagtttgggtaatagagtaagattttattttaaaaaaataaaaaataaaaaaagaatttttagagtaatttttaggtgttagtaggggtgtgatgtaattttagttttgtttttgtggtttattggttttgggtaagtttttttgttgttgttatttatagagagtttttaggggagtttgggaatgatggtaagttttatgtgatttagtatgtaaagggagttttaaaatttagaatttagagagttagggtgggtatagtgtagttggttttagtgttgaggggttgggggagagattttgtattatgttttgattatagtaagggaagattatggaggtttttggaatgttttagtaatggtgtaattttagttttttttatttttttgttaatgataattatgattatgatagtagttaataggttatagagtaggtattttttagtttttttaaatatgaatttgtttaatttttataataatatagtattgttttatttaataaatgaggtaggttgggtgtggtggtttatgtttgtaattatagtattttgggaggttaaggtaggtagattatgaggttaggagtttgagattagtttgattaatatggtgaaattttatttttagtaaaaatataaaaattagttgggtgtagtggtatgtttttataattttagttatttaggaggttgaggtaggagaattatttgaatttgggaggtggaggttgtagtaagttgagattatgttattgtattttagtttgggagatagagtgagattttgttttaaaaataaataaataaataaaattaaaaaatattatatatataaaaaaataaatgaggtaaatgagatgtatgaggtgagaattttgtgttatagggagaggtgtagtttggtgagatttaattttaaggggttggtggttttgagtttttaagtgtaattattggattatattgtttgtagattattattatttttattttattggaaggttgggtgaggtaattgggaaagtttggagtagtagtggagttgttagagagaatttgtttttagtgtttttttggattttgtagttgttttgtgtgggtttttgttgttttttgtattggaaaagatttttttatagatggggttttatgatgttatttaggttggagtgttgtgtttatttttaggtgttgttatagggttgtagttttgaatttttggttttaagtgatttttttgttttagttttttgagtagttttttgggtttaagtgatttttgtgttttagttttttgagtagttttttgggtttaagtgatttttgtgttttagttttttgagtagttgggattttaagtgtatttggttaagtttttttttattttttattatttaagatttttttttttttaaggtttagtttaattttatttttatttaaaatttttggggtatttttgtagtatttggaggttgaattgtttaggagggaagggtgttaatgagttggtgttttgtttttattttgatttttggtgagaatgtaagttttttgtaggtaaggattatattttattattatttttgtatttatttagatttggttatgtgtgtttagtatataaagtgtttttgatgattgtttatagatttatggtatttgagattgttttaatatatttttttaaaattttttttttttttagaggtttatgaatgtttaaattaggtttattgggaataatattatggttattttgtttattttgaagtttatatataggtttggaagtaataattttgtatagtttagatgaaaaaataaagatttttttgttgtttttggattgttagagttttgggggatttttaatattttttgttgttttttttaattttatggtgttgatggtttgttggggggttagtttgatttttgtgagtgtttgtatttggaaaagggttggtgttaagatagttttaggatatttagaatgagggtaagaggttatttttattattagttttttttagttttattttatataattgtaatatagtgatttagtatattttgggttattgttaagtagggagtaaattagaaatggtttgagttttttttttttttatttttagaggggtttgtttttttaggtaaatataaggaggtattgaggttgttgtataagagttggtttttgtttattttataaattttatttttatttattgtaaaaggttttgtttttttttttaaaaaaaaaaaaaaaaaagaaatttagtgaggggtggggtaggtgtgtgtggaggagaggagaaaaggataagtgatggtttttttattttttagtaagttgtaggtgtagagattttaagtttgttttagggtttttttggtatttgtgtaggagggtttttgtagaaaaaatttaggatttatgatttgggaggattttggttatttttattgtttggatttattagtgggaggtaaagtgtaagaaattaagggtaaagggttttttttgggtgggttagagattttttggaaagggttatgtattgtgtgatttttataataattttaagtatttggagtatgttggggaggaagttttggtgttaaaattaagtatgtgttatttggaagtttgtttttgtttattagtatattaatttatttatgtttttgatagagttgtgttttgggtgtgtagagggttattttgtttgtaataattgggtgaaagttgaaattttaagttattgatttagaagggtatttttggggaagttttgagtaattttttttgagataaggtattttattatttattttggtttttaaatatggaaagttagaggaaattgataatggtttaaaggtagggggatggttttgatgatttttttatttttaattaaggtttatgattttgtttttttattaataaaaattaatttatggatttttggtaggtatttttttatttgaatgaattaaaggagggatattaaataaatggtttttagatttagaagaggagatgttatttataatttgaggattgaggaggataaaggattttgtttgtttggattttttggagaaaattataaaggaaaaaaaaaaggaaggaaaagataaataatgaagatttggattttttttaatttgtttttgtggttttggtgtgtttatttgtgaaatggaattttagagtgttagagtgggagttttttatgaaatgaaagtttttgaattggtttatggtgaggtttaagttaggttttttttgtttatttaaggtgggttttgttagggtggagtgaggatgttagttgtgggtggtgttttgagtgtaaaatgtgaatttgagttgttaagtttgggtgttgttggatggttttatttggaggttgttttgtgttttattaagtagaggagaaattgaagagaatttgaagaaaggatgttgtggtttggattattagttttagaggttgaatttaaggatatttttttatttagttttgattttatttatttatatagatgtatagggatttaaagtatttggttgatttggaaagttagtgatttttgtgagggtgtaaggggtgaggaagagggagtgttttttagggtagtttttttgatatttgagtaagggttggagatagtgtaggggatggttggtttaggttgaaagtggtttgatagtggttttgttttgggaggaatttgatttgtagtgtgtttgttgtggggatttgtttagttttgggggtgttttgttatttttggttgtaggtatttaggtgagtagtgttggttttgggatattgatttttttttattttgggtgtgaagtttatttgagtaagatttttttatggtgtttttgtggttgttgtttttaggaaagtgtggtggtgaggtagtggggtgtgtgtttttagggtgttaattttgggttggtagtaggaaggtgggaagagggggtggtttgttgtttggagtgtattgattgggttttgttttggttttgtttttgttttgtttttttttggagatgtgtatagaattttggtttagttggttgtggttttgtttttgatttgttttttttttgttttgtgaatgtgtgtgttgagttttatttttgtttatttttgtgttgtgttgtatttggtggagtggggttggtgggtgttgggtttgggagggggtgtttttgtgtggtagtgtagattagattagattaggttaggttgggggtgggggttgtttgtgtggtttgttgtgtttgtagttttgtatttttagttttttgtgttggtgttaatggttggttttgggagttgttgtattttttagttttgagtttgggtggggtgggtttggttaggtggaagtgggtggaggtgtgggtgttttgggtggttttgttgggtgaggtggtggtgttgggtattgtggtggtgttgggtatagttgggggttggagttggggtgttggtttagtgggttggggtagggtgggataggatatttgttttgttatttttttggtaattaaaagggtagagtgtgttgattgagttggagttttagtttttttatttgtaaatgggtgtgttggatagatgattatttgttttttttgtgttgggtattgtgtgtagtttggtgtattggtgtagtggggtagatatagggagttgttttttataatttgggtaatg

SEQ ID NO: 12 - DNA, 1405 bp, Artificial Sequence
  chemically treated genomic DNA (Homo sapiens)
tgttatttgagttgtaaagggtggttttttgtgtttgttttgttgtattgatatattgagttgtgtatggtgtttagtgtagggagaataaatgattatttgtttaatgtgtttatttataggtgaggaaattaaggttttaatttaattgatgtattttgtttttttgattattagaaaagtagtaggataggtgttttgttttgttttattttggtttattaagttggtattttggttttgatttttggttgtgtttggtgttgttgtggtgtttggtgttgttgttttgtttggtggggttgtttggagtgtttgtatttttgtttgtttttatttggttgggtttgttttgtttggatttgggattgggaagtgtggtgatttttggaattagttattggtgttagtgtggggagttgggggtgtagagttgtgggtgtggtgggttatgtaggtggtttttatttttggtttggtttggtttggtttggtttgtgttgttgtgtgggggtgtttttttttaggtttggtgtttgttagttttgttttgttaggtgtagtgtagtgtaggggtgggtgggggtggggtttggtgtgtatgtttatggggtggggagggggtgggttaggggtgggattatagttggttgggttggggttttatgtgtatttttggggaggggtggggtgggggtggggttggggtggggtttggttggtgtattttagatggtgggttgttttttttttttgtttttttattattggtttaggattagtgttttgggagtgtgtgttttgttgttttgttgttatatttttttgggagtggtggttatggaggtattatgaagaagttttatttaggtgggttttgtgtttggggtggggaggggttggtgttttgggattagtgttgtttatttgagtgtttgtggttgggagtggtgaggtgtttttggagttgagtgagtttttgtggtgggtatattgtaggttgagttttttttaggatagggttgttgttgggttgtttttgatttgagttgattgttttttgtgttgtttttagtttttgtttgagtgttggaggggttgttttgggggatgtttttttttttttgttttttgtatttttgtaggaattgttgattttttaggttggttgggtgttttgggtttttgtgtgtttgtgtgggtgaatggggttggggttaggtggaggggtgtttttgggtttagtttttagggttggtggtttaggttgtagtattttttttttggattttttttggttttttttttatttagtggggtatgggatggtttttagatgggattgtttagtagtgtttaaatttggtgatttgggtttatgttttgtgtttaggatgttgtttgt

SEQ ID NO: 13 - DNA, 1405 bp, Artificial Sequence
  chemically treated genomic DNA (Homo sapiens)
gtgggtggtgttttgagtgtaaaatgtgaatttgagttgttaagtttgggtgttgttggatggttttatttggaggttgttttgtgttttattaagtagaggagaaattgaagagaatttgaagaaaggatgttgtggtttggattattagttttagaggttgaatttaaggatatttttttatttagttttgattttatttatttatatagatgtatagggatttaaagtatttggttgatttggaaagttagtgatttttgtgagggtgtaaggggtgaggaagagggagtgttttttagggtagtttttttgatatttgagtaagggttggagatagtgtaggggatggttggtttaggttgaaagtggtttgatagtggttttgttttgggaggaatttgatttgtagtgtgtttgttgtggggatttgtttagttttgggggtgttttgttatttttggttgtaggtatttaggtgagtagtgttggttttgggatattgatttttttttattttgggtgtgaagtttatttgagtaagatttttttatggtgtttttgtggttgttgtttttaggaaagtgtggtggtgaggtagtggggtgtgtgtttttagggtgttaattttgggttggtagtaggaaggtgggaagagggggtggtttgttgtttggagtgtattgattgggttttgttttggttttgtttttgttttgtttttttttggagatgtgtatagaattttggtttagttggttgtggttttgtttttgatttgttttttttttgttttgtgaatgtgtgtgttgagttttatttttgtttatttttgtgttgtgttgtatttggtggagtggggttggtgggtgttgggtttgggagggggtgtttttgtgtggtagtgtagattagattagattaggttaggttgggggtgggggttgtttgtgtggtttgttgtgtttgtagttttgtatttttagttttttgtgttggtgttaatggttggttttgggagttgttgtattttttagttttgagtttgggtggggtgggtttggttaggtggaagtgggtggaggtgtgggtgttttgggtggttttgttgggtgaggtggtggtgttgggtattgtggtggtgttgggtatagttgggggttggagttggggtgttggtttagtgggttggggtagggtgggataggatatttgttttgttatttttttggtaattaaaagggtagagtgtgttgattgagttggagttttagtttttttatttgtaaatgggtgtgttggatagatgattatttgttttttttgtgttgggtattgtgtgtagtttggtgtattggtgtagtggggtagatatagggagttgttttttataatttgggtaatg

SEQ ID NO: 14 - DNA, 2365 bp, Artificial Sequence
  chemically treated genomic DNA (Homo sapiens)
gtggttgtggtgggggtgttagttgtaggggtgtttttggtgggtgggagttggtggttttttgttggtgttatgggatttgtatgtttgttttgtgttttttggtttttgagtttataggttgggattttgtttgttagttgtgtgtgttgttgtttaatttttgtaggtgtagagtgtgtggtggtggtgatagagaattttgtttggttgtttaaatatagttttttgtagaaggattttgtgtttggggaaggggaggaatttttttttttttgggtgtttgttttttttgttatggtttggtttttatatttgtttatatttggttgtagtggggtgtttggggggaggggttgaggttgtgttttttgttgttttttgggtgtgggttaggtggggaggaggggggtgttttggttgtgtgtttaggattgttttttagtggttatttgggttttagttttttaggtttggttttgataggtgggtggagtagttagtgtgagatagggaggttggtgtgggtgtgggaatttgatttgtttgggaggtgggggtggggtgggggtgtagtgtgtggggaggggttggtgtttgttttttttttttatttatttagttgagttagggggtttaggggtttttttggtggttagttttgtattgtaggagtgtgggtgtggtgttttagttagtgtgtagggtttgggttttgttgggggtgtttttttgttgttgttttttgtgtgatttgttgtttattagttattatgttggattttgtggttaatgtgtagttggatgggattattttggattttgaaggtgggtgttgggttggttgttgtggttgtggatgtgttggagaggattttgtgggtgggtttggtgtgggatgggggtgtgttgaggggagatgggagtgtgttgaggggagatgggatttttaatttaggtgtttttttgttgagagtgttgtgtgtttttggttttgtgtttgtgttgtttatgtgggggattttgttaggggtatttgtgtagattttgtgtgtttttataggattttgtgtttgttttgtgtattgttgtttgggtttttttttttttattgttgtttgtgtttgttaagtgatagtgatttttttgagggtttgtgaggttgttttggaattttttaggatgtatagttttattttgggaaatttattggttttttttttttggttttttttggtggtttttgggttttgtttggatttggtaatgggatagggaggttgttttttatttttgattgagtggatagttgtgttttgtttgggtggatagttttttttttttttatgttagttttggggttgttaagttgtgtagtttgtgggttgggagtattgaatggatatagtttaggttgtggtagggtttagagtgggatgttttatggtttttatttaggtttggggatatttttatttgttttttagaattgggttgtgggggatagaaggggtttgtgtgtgggtagggagagtattttggtttttttttgtttttggggtttataaagtgtgttgggatttgtggggttgttttgtttaagtttgggtttggtgtttgtgtttttgagtttgtgagtgtgtgtgtttttttgtgtttttttgattgttggtgttggggttttgtgttttgtgtttgtgggagtaaatatagtaggtgaaggggaagtttatataatggtttttagtgttttggggtagggtttttgaggggtgggtttgtttttgttgggatttggagtttttgttttttggagaggtttttaggttgatttgggtagagttttttggtgggttgggagggggaaaggttgtgttgaaatgagtaaattgtttaggtgttaggttaagttgggaggtgattagtttgaggttttttttgttttatggttagaattagggttgatatttgggtgttttgagtttagttgtttatatggtttatttggggttagttttatttgagtgggggaggtggggttttttgggggattagaattttggttggatgttaagtagagtgttagtggttgttttttagggttgggtttgaggagggtgtggggtggtgaagggatgggagggggttgtgatttagtggttattggtgttgtgtagagtgtgagttggaaatattgtagttattttgttagtttagtggtgaaagtttttttttaggttttatttttttgtatttttgttttttagagggaggggaggtttgggtttgtagagttgggagggtttgttgtttttgttttttttttttataatatttttttatttggatatttttgggtatatgt

SEQ ID NO: 15 - DNA, 2365 bp, Artificial Sequence
  chemically treated genomic DNA (Homo sapiens)
gtatgtgtttaaagatgtttagatgaggaggtgttgtgggggaggggggtgggaatagtaagtttttttagttttgtagatttagattttttttttttttgggaagtagggatgtaaagggatagagtttgaaaaagggtttttattattaagttgataaagtaattatgatgtttttagtttatattttgtatagtgttagtggttattggattataatttttttttgtttttttgttgttttatattttttttaggtttagttttgaagaatagttattggtattttgtttggtgtttagttaaagttttggttttttaggaggttttgttttttttatttagatagggttgattttaggtgggttgtgtgggtagttgggtttaggatatttagatgttagttttggttttggttatggagtggggaggattttaggttggttattttttagtttggtttgatatttggatagtttgtttattttaatatagttttttttttttttggtttattagagggttttgtttaagttagtttaggagtttttttgaggggtgggggttttaggttttggtagaggtaggtttgttttttagaagttttgttttagagtgttggagattattgtgtgagttttttttttgtttgttgtatttatttttgtggatgtaggatgtagagttttagtattggtagttaagaggatgtaggaaagtgtatgtatttataggtttagagatgtggatgttagatttaggtttggatagagtagttttgtaagttttaatatattttgtaaattttgaagataggagagagttaaaatattttttttgtttgtatgtaggttttttttgttttttatggtttgattttgggaggtggatgaggatatttttaggtttggatgggggttatgggatattttattttagattttgttatgatttgggttgtgtttgtttggtgtttttggtttatgggttgtataatttggtggttttgaaattggtgtgggggaggggagggttgtttatttgagtaggatgtggttgtttatttagttggaggtgaggaatgatttttttattttgttgttgggtttaagtggggtttgagagttgttggggagagttaaagggaggggattgatggattttttagagtgaaattgtgtgttttggagagttttgaggtagttttgtgagtttttgaggaggttgttgttgtttggtaaatataaataataataaaaggaaggaaatttaggtggtagtgtgtagaatgagtatagggttttgtgagggtgtgtagggtttatgtgggtgtttttaatagggttttttatgtaggtggtgtgggtatggggttgggggtgtgtggtgtttttagtgggagggtgtttggattaggggttttgtttttttttagtgtatttttgtttttttttagtgtatttttgttttgtgttaggtttatttgtagggttttttttagtatgtttgtggttgtagtagttagtttagtatttatttttgaagtttgaaatgattttatttagttgtgtgttgattgtggggtttgatatgatggttggtgggtagtgggttgtgtggagggtagtggtgaggaagtgtttttggtggggtttgggttttgtgtgttggttggggtgttgtgtttgtgtttttgtagtgtagagttagttgttggaggagtttttaggttttttggtttagttgaatgaatgggggaggaaggtgggtgttggtttttttttgtgtgttgtgtttttgttttgtttttgttttttgggtggattaggtttttgtatttgtattggtttttttgttttgtattggttgttttgtttgtttgttaaggttaggtttggggggttggggtttgagtggttgttgggggatagttttgggtatatgattggagtgttttttttttttttgtttggtttgtgtttaggggatggtgagagatgtggttttagtttttttttttgggtgttttgttgtggttagatgtgggtggatgtggaggttgggttatggtgaggagggtgggtgtttagaggggaagagatttttttttttttttgggtgtagggtttttttgtaggaggttgtatttgggtagttaaataaagttttttgttattgttgttgtgtgttttgtgtttgtaagggttaaatggtagtgtatgtggttggtaggtaggattttggtttgtgggtttaagagttgaggggtgtagggtgaatatgtgagttttatggtattagtgagaggttattaatttttatttattgagggtatttttgtagttaatatttttattatgattat

SEQ ID NO: 16 - DNA, 3791 bp, Homo Sapiens
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 17 - DNA, 3971 bp, Homo Sapiens
ccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtgtggggttctcagtgccggatggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 18 - DNA, 3921 bp, Homo Sapiens
gttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 19 - DNA, 1328 bp, Homo Sapiens
cgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacctgcccctcctggagcagaaagtgcctttatctcagccatccgcagactgcttggccagatgcggggacaggctggaatga

SEQ ID NO: 20 - protein, 586 aa, Homo sapiens
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 21 - protein, 190 aa, Homo sapiens
MTLCPQAWLPEGSEEQLRCADHPCGVLSAGWGGGQASHLQRSPVGCTLPSIPIGPVPWSVSEPRGECSPPGAPGPPARHMVWPSLSPYPCPAPKGRKLQGPLPPTAQPLQAPWQLPLLEQKVPLSQPSADWPDAGTGWNEGGVFISLPSPSHATPAPTGLQVLLMRWDLIEDKKEGEMTPTPSSPSFEKV

SEQ ID NO: 22 - protein, 422 aa, Homo sapiens
MEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 23 - protein, 197 aa, Homo sapiens [sequence omitted]

SEQ ID NO: 24 - DNA, 2804 bp, Homo Sapiens
ccaaggcccgccggacctgaggtcgcctggggcgctaaacagacccatctatgagcacattcggccaacacacccaagttcaacagtgggcgggatctttggctggcctcgatctctctcacagtgtgtgcaaacgggtacccattagattctttttgcttgtttcctcatctgtaaactttgaaaggagagtatttcccggggtgattctgaaaatcatgccagaactgaaaaggcctgtgtaaatgcgaggtgtaatgatgacttattagaagcagccagccctgtacgtgcctgtaggatagatgctagaacgttctacaaatgtgtgcacatacacatcacgtatgtgtgaaggtgcacacctgtccctagacacttgacaaatgcacacacgtatgcgtgtacctctggctgagagcaaaggggctaatacagggctcatacaggacatcatcctgcagtcttgtgcgtgcacagtacacacgcgagcacgactgtctgtgcctggagacaccgtatggcaccggaggagctgctcagccgtcggtgccacctgggaagtagggtttcgggtgctgctctggagcgcgggaaagtccggatccgggtctgctggtcagcgcttcggcgccgccgggctcctttatctctcatccgccggccggtgagcggctccagtttcaagacccccgatcctgccggtgaggggagggagcgagaaggagtgcgctccgggcccaagaggctgcagggccccactccccaggtctgtcgtccttcctttatctcctcaggtcacacccccacttaaaataaagaagggtgcctgactcattcaggtcagggaagtcggcccccgggagcctcctgccctcacaagccatggtgaagggaggcgaagccagggtttgccacggcctgggagaaaatgcggctgcagggtctctttgggctgcagcgctggcccggggccccaagactgttaaggtgtgtgtgggaggcgcgcagtgtggctaccgaagagccctccatcaccgcaccggcaggccgccgggctcgtcctcctctcatgcttccaagggttctgagctgcgcagcactcgcatcacccagaagtgtctgtggagaaaacgacctcaggtgtaagcccaaggctgctgcctgcaaaggcaatgccgtggagactgggttccacagcgacctgggtttttaagtcaccgaaagctacagggcagggtcacaaacactctcccgccttctctgcagaaccgtgcggctgacaggagagcgttgcgcagaaaattcgaggccgggcgctggaggagtctccgcggcccggagaaggcacagaggcgcccctgagaggcgcagctggaacaggcgatgcacgggttcggatctggccggccaaccgagcccagcggtcgcgaaaaccagagtcgccacagaggttgagcacgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggggtggggacagcccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggag

SEQ ID NO: 25 - DNA, 3952 bp, Homo Sapiens
ggccgcagccggagaggaacaggaaccgcagtggggacgccctggtccccgggcccacagcatccgggacggacgcgcagtagcgcgggccgggaactgggtaccagggcgggatgggtgagaggctctaagggacaaggcagggagaagcgcagcggggtgcggggaaccgcacgccctccctttgcctctgcttcccaccccgaggcggcagggcgggcgggcgcggttccgggggtgggcgggctgggcggggcggaggcggggccgcagcactggcttcacccagcctctcccgcccgcagccagagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgagtgttagccggagggggcccgctccctttcccgggatcagaactccgagaagagccgggcgccgccaccaaggaaacagaacagagcattggggtcccagatactgagggtgggtggtgggaaaggacctctgatgccgggaccacgaaggagggtctagggttcccggagcgcagaggcgactctccagggtggagatgagggcaagaccggagcacggatgccggtcctcaggtaccgcagggggcggtgggggagctgggaggggtctttcaagagggggcatggggctctccgatgcccaggttcttcggaagaggacactcgaatgccgggatcccgaagggactttcccctcagcatctcggtctctggagagtcgtgggacagaaccaaggcgagagaaggagggggaactggacggggactagagatgagaggggcgagctgggctggggcggggagcccgggacgacgggatggaacaatggaggaggtcggagggactggaggcagaggggacccggcaaggacaatggggaccggccagacaatgggggggaggggcgtcggagggagaggttggggagcgggagagaggttgagaagtgggttagggagggcagaagaggggcgacggcgagggcggcagagagatggaagcagaaggaaaggagacagagcggggcgcggaccctgaagtggtcggggtcccgcctgcccgctgagggacagtgagacgagaagagagagcagaggcttggacatttccagcgcctgtccccgcgctcctgctcgcggcctctcccagtcccggaattggggctgcggatctaaggctgggaggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcccagtctggctcaagcgcctcgcttcttccctgggggaccgcgtggggaggcgggaataatcgatgtgctgagttcctactaagtgccttgcacttccctggtagtttctcttgaattatttaatccttataaggtcctagcaaggtgaatttagttattcccacttcgcagttgaggaaacagaaccttctagactttcaggcccgagaccaggctcccccagtgagtcagtggtggcgtctttgttggaacccaggatgcttggcctgggatgttctctttcctacatatgccaggctccctcccgccccctaccttctagatcatggaaggagtcgtggctctgagagattaaatcgtgccctatgcctttggccccacacatttagatctgagccccttctccacacgcagaggccctgccccctctcaagtctctatgctacattatcttgggtaattagctcctttcctcccaactcctcccctatccaaagggagtgaggggtatgtgccagtgcctcccctgggtttgcatcgacctcaaaaggccctccaggtgtttgaaaatctctcccatcccatggcggtgaccacggccccattcacttaagagctctttgctgaagctgttggaatggccagggctgattatactgaaacattcgtatggtttcaaatactttcaactgtttcgctgtttctctcttttctctaattaaaaaaaatgaaaattcttaaaagtcaattcatctaaggatccttccaccttagttccttgtaagccttgaaatggccaaaacaaaaagattacaagcgttcttaaaaatgagatgaaatcattctgtcaaatgtgaaatgactaagtgtaacacatacaaatttcagggaaatttatctgtcatccctataaattaatccttttggatctgattttggagcaattagcctgaatgttagtcacccctccctacttggctaaactctcccctcctgcctggggtctccttaagatgagatgcttctttgataactaacatttatt

SEQ ID NO: 26 - DNA, 2820 bp, Homo Sapiens
cctaggggacaatacccaggcatgttaacggagtttaaaatgccaaggaaattacaccacaattctgcccagtatactacaggctgtcaaaccgaaatgctatgccagctaggagtgcagcaactcccatcctctggccctatttaattaggaagcttcagcagagcgaagcctgccaagcgttcgccgtcagaatctgaaggaacccgagcgagcaagaagagtgcctgacccactccacagaagcctgtccagaaatggaggagtcagcgcccactgaagtcggttccgccctcggctcgcctacatggagcctgaccagcctcagtcatgcccactccggcctgggagacccgcaaagtgttctttttctcaactcccctgtactaccttgaagcttagggaagcaaagagaggggcatatctggactgcaaaaccaatgtcttttgccgcctaggagagaagggaatgagagagagagagagatagatagatagagagagagagagagagagagagagagagagagagagagagagagaaattctattgaaacccagctcctctagaatctgtgtgacctggtcttcaacgggagaccagtgcgacctcatggcacctttgccaggaatcagcgattcccctgcagtcaccatttgatttattgctttctcgctcattctttctcataaagttatttcttcctcatcctagtaagacttttttctttaatgatgacaaagcttctgtttcagtgtttcccctaggattggtgctctttcaaaacagtgaacccagaaaaccatcccgtttaatatttctcaaaatcctcgcagctccaatgtaagcgcaagcatgcaaaggtttcctgctacacctgcactttctgcccatcccagaaccacccctcacccccgggcctgcaacagttccccttgtttctctggatagaggtgggtggtattaggggtctagggcagtaggaggtgaggggctgaggaggccgctagggtaggctggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcagcgggctactgagcatcccgcggacggcggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggagacgggagtccaggggcagacgagtggagcccgaggaggcagggtggagggagagtcaaggcgccccgcagcccggcagccgcctctcgagctctgccgcccgcatccctctggcgtttgggaagcagcaggtcctcagcccgcccggggtcacgtgggaagaggcagtcgggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccg

SEQ ID NO: 27 - DNA, 3104 bp, Homo Sapiens
gcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccggcgtgcctgagccgagccgagcccgaaccccaagccgcggagccagcacctcctccagtcggggtcgtccgctcccggccgttgagccaccgccgccacccggtagtgtgtcccgctgccccaatccgcctcatcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacaggtcggtacctagaggcctccgcgctttgagcgcaccggggaggaggcgggtggaggcacctctggcgcccttacccagtccctggcgactccaattcagcaggagttgggagcgcggtctgtcttgggttaagagccctgcgttctgggctcctggccgggagttcccttgccggctctgcttccccacccgctggctccccacgcctgcgggcagctgcagcagctggtcccggtcaccaaaccaaggcttcactgggacggagaggggaagagaaataaaaaattaaaatcctacaaacagttagggaccccaagacccaaagctaattcttgtcagcctgggcacaggctcctactattaatcgaagcctggcttattagcaatgtgtcggtttcatgttaattatcattttcaaagcccaggtatatccctccctaatgctttgaaaacagttttcaatggacttttgagaaatgggaagtcgagttttcctcttcccatgcgctgcctgccactcttgtctcaaaacagcaaactagtccgtgggccgaggcttttcgtttcccggagtgtggatctcgattagccaaacattttgcggaagagcccggcctcatcccccaggcccaaatgctccttacaatcctttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgccgggctggagggacgcaggaggtggtgggggcgggcgacgggcggctgtgttacgagctgtgacccgtgttccctttcttccccgtagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcgtgaggcctgacccagcaccacgttcttcttgctttgctttttcctaaggattttgctgcaaagtctcttcggaacccgaactgcaagctgagcgcctgcccagattctcccatgggtatttcacgtcgaaaggacgctgttacatatgtataactttcgctttaaagtttttttttaacaaaacatatatatgctgtttatttacttatttaagagaccgccatggtaggtttctctgtagcttggggaacttgctgtttctaaacatgcaggctggtggtgatgggttctgtgtggagaagccaaacaataaaacaacctagtgggcaaccttcttaattaagggagctgctctcagattccttttcttcttattattattaatatcattcccttcaccaggcatgcagggacccttgagcaaatggtctccggaaggtcttacctatatatcttttgccttctttggtgcttcctggtatatgttttaaacaacctatggtaggtctataaccacctcccacgtcaaattacacgtatgtgcatatatgtatgtacctatacaaacatatgtatgtacctatacaaacatatgtatgtatgcatacacgtgatatatttaaggctagaaattggcaacatgtgagcgtcctctcta

SEQ ID NO: 28 - DNA, 2378 bp, Homo Sapiens
atcctgagattttagctgactttttctgttctgtaatcagaggggactgtgatttgggccaatttcttcctcatgggcttcagtggagtcagctgtggaatggaacatcaattcccaccccataggcatgttgtgaggtttcgctaagaaacagccataaaagggccttaagagttatgatgattgttttaaccatttagtagggagggggcatccagcggtgttgctcccacgtaccgatgtcacgtggggcggggaggcggggcggagaacggagagcgtcctctcattctccacccccttcctccaagtccagcgcagggggaggtggctgcgactgactgaggggctagggaaggctggccaggggcgtgggcgtggctggggacggcttgggggtggggctgcgcaggaggctggaggagccccgcgggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggcggggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccggtgagcgcgccaggccggggttgggagagcgccgcgtggtgtggacagttaagcgcctgcgttcccgtgtgccttgcgccgtgcctttgcctccctcacctctctgactgcctgcactacatctctgttaggggtcagcctgtctgtttcacagataaggaaactgagccttgggaaagtttagtgacttgctcagtggatcacagtgaactaagatttgctcccagggctagtggggtgaggaatggagttacaggacaggagtccgtccctggctctatggatggagatggcatcctattgccaattctccctctcccccgccccccaagcccacagctctccttcccaccggcttgggttcccgtctatgacaccttctctcgccatcatcccatccctctcccaatgagagaagaagggaaacacaacgctcagaaaagagggagggagacctctcctttccctcctccccaggctgtaaggcgtgctggcctgaggctgcttactcccttcttgccgccccaatccaacttctgctccatccttcattctggttcttgcaacaggccagacatgatctcattctgcagctgctgatgggaaacagttttctgctgggaggcatgggtgggggaagaggacaccggggtgcagagcccggcggggaccaggcagagtgtgtgttctctcccttcaccccacttagcaccaagatgccgcaagagggtcaaacagaggcctggttgccactcttgcatgtctcttgggatctctcctggagtatgaagacctccaaggactcactttccctcccttctgatgccagagcagaccaagctgtcacactccagtctcatgctgaagtctccagcttctcaagcttagaagagtttttggaagagtcactttcagctcatgcagctctcacaagtgtgaagggagtgggttgggggtgttttccttgccattttcgaaaagaaaaaaattacctggtg

SEQ ID NO: 29 - DNA, 2436 bp, Homo Sapiens
agttctggatgacaaggactaattgcccagggcgttggccgagaggaataggaagagcgccccgtggagcagggcgggcgagaagagccgggcggccgcggggtcctcgcgcatgctgggcaggaagaggaagagctgcagcacgaaggtcaccagggagatgcacaagaagtaggcgggggccaccacgttgagcagccgcagggccagcatcctcgattacattcctgcggggcccggggtgagaagaggactgactgactacggcgtccagggggcgccctcgcccgctcctccgtgccgcgcgtctggggcactgcacgcgactccacgcccccaaccccctgtcccgcggatttcccctccccagttccctaaccccggatcaggcaggccagagacccgagcccgcagcggcctcgggtctaggccccacctgggggtgagtgttgcctggggttttgagcgagctcggcgccttggcgcggcagagtctggcacaggagggagggactcgtttgcagtctttaggagttgtgagggtggggggcaccgggggataggactcctcccctctgtggatgtggaaacaagcccaggtttgggatttctggttcagacctccctaggaggagaaagggaaggatttggggtcgggggcaggagaatcagcggcacttgacctgctggaaatcctgcttcacactcccctttctccgtccctgcgtccccacccacacacacatcttgggcagcactcagggacctcaccaggttacccaaggctctttggaggtatgtgtgcgtgagggaccacgatgtgtgtgtgtgtgtccttgtctgtgactctgtacgtgtaatctgtgtgcgcttgagtatctgtatttgtgtatgtatatatctgcgtgtacagacacgcagcctctgctatctagctttaaaaaaatcaattgaaacaatcgatacactcacactcgctctcgggcaccgggtgaggtgggggcgcaaccagaatacctgtgtcagcgggtcctggccagcacatctctccaacgctggctgcccgggctatttctttgcgaagagcgttttcatttgaggcgaaattaaaatccccccttcgcgcccgcctcccgccctcctgctgagagaaacccaaacaaccctcatggcgccgaaatcctttccatgccgacaagcccgccctgggcgcacgagtggatgcttggccagcctttcctgggatcgaccccgccgccgtgctcagccctcaccacgtccccatcccaccccacgcctcacagccggggttcctggccagcttcggaagccaccgagaaataggattccgtgcgcccgagagaacttttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccg

SEQ ID NO: 30 - DNA, 2804 bp, Artificial Sequence
  chemically treated genomic DNA (Homo sapiens)
ttaaggttcgtcggatttgaggtcgtttggggcgttaaatagatttatttatgagtatattcggttaatatatttaagtttaatagtgggcgggatttttggttggtttcgattttttttatagtgtgtgtaaacgggtatttattagattttttttgtttgtttttttatttgtaaattttgaaaggagagtatttttcggggtgattttgaaaattatgttagaattgaaaaggtttgtgtaaatgcgaggtgtaatgatgatttattagaagtagttagttttgtacgtgtttgtaggatagatgttagaacgttttataaatgtgtgtatatatatattacgtatgtgtgaaggtgtatatttgtttttagatatttgataaatgtatatacgtatgcgtgtatttttggttgagagtaaaggggttaatatagggtttatataggatattattttgtagttttgtgcgtgtatagtatatacgcgagtacgattgtttgtgtttggagatatcgtatggtatcggaggagttgtttagtcgtcggtgttatttgggaagtagggtttcgggtgttgttttggagcgcgggaaagttcggattcgggtttgttggttagcgtttcggcgtcgtcgggtttttttattttttattcgtcggtcggtgagcggttttagttttaagattttcgattttgtcggtgaggggagggagcgagaaggagtgcgtttcgggtttaagaggttgtagggttttattttttaggtttgtcgttttttttttatttttttaggttatatttttatttaaaataaagaagggtgtttgatttatttaggttagggaagtcggttttcgggagttttttgtttttataagttatggtgaagggaggcgaagttagggtttgttacggtttgggagaaaatgcggttgtagggtttttttgggttgtagcgttggttcggggttttaagattgttaaggtgtgtgtgggaggcgcgtagtgtggttatcgaagagttttttattatcgtatcggtaggtcgtcgggttcgttttttttttatgtttttaagggttttgagttgcgtagtattcgtattatttagaagtgtttgtggagaaaacgattttaggtgtaagtttaaggttgttgtttgtaaaggtaatgtcgtggagattgggttttatagcgatttgggtttttaagttatcgaaagttatagggtagggttataaatattttttcgttttttttgtagaatcgtgcggttgataggagagcgttgcgtagaaaattcgaggtcgggcgttggaggagttttcgcggttcggagaaggtatagaggcgtttttgagaggcgtagttggaataggcgatgtacgggttcggatttggtcggttaatcgagtttagcggtcgcgaaaattagagtcgttatagaggttgagtacgattttatttttggggatcgggttcggtggggagttattgtttttaacgtttttagagattttaagtaggataatataatgttggtaggagtaaggtgtaaggaatttagcggtagaagtttttcgggggggtggggaaaggtagattcgtgtttcgtttgagtttgggggtggggatagtttttggttttgtagtttttgtttcggggattagttgggtttatttaatttttttatatggggttgaaaggggttaatgggacggtttcgtcgtttttttttcgggattttatagggttttgattcggtttttatttttgtacggttagtagtcgcgggggttttaggaaggaggataaaggttcggtgttatcgcgggcgggggttcggttttttggttttttgtttatatttatagtttttagcggttgttgggggaagatttttaaaaatatgtgtcgaatttttttttttttttttttagaaataaataaataaaaaaggtaaaaggcgaatttttttttatttttcgtttatagagattaaagttttttgggattttgttttttttttttttttgattgtttagaaatatttgtttttttttgtatatagaggaaaatgcggggaaaggttttttaaaattcggttttatattattattattattaaggataatcgggtaggttgaggttttaacgtggatgattcgagttggtttcgcgtcggggttttgtagttattgttttgtgcgtttagtatttttgggggcgattagggtttttgcgttttcgttcgtcgttcggtagtcgagagtattttgtgtttagattggtcgatttattttttttcgaattttgtttagagttggtaagggggatttagttcgcgttttaagatttgggtttgtagcgtcgttaataggttcggggatacgaggcgttttaggtcggggttttttcggttgttggtttttttcgttttttattcgttggcggcgtttcggtcgttcgtaattgatttaattcgttttttgcgtttgttttttaggtttttcgtttttttataaaggtttaggggagtttcgtttataggttgattttgtaatttttggttcggtggttattttttgtttttttgaaaaagaaaaggaaaaaaaaaaaaaaaaagaaaaaattaattagtcgagggaggcgcgtgaggattggaggcgttagtcggatagtttatgagtaggtttttgggtcggtgtcgtttcgcgggttagtacggttttttttagagaaaattttttaaacgtgtgaagatcgttttgggggaagcgagagggaggttggaggag

SEQ ID NO: 31 - DNA, 2804 bp, Artificial Sequence
  chemically treated genomic DNA (Homo sapiens)
tttttttaatttttttttcgttttttttaaagcggtttttatacgtttaggaggttttttttgagaaaggtcgtgttgattcgcgaagcggtatcgatttagggatttatttataggttgttcggttggcgtttttagtttttacgcgtttttttcgattggttgatttttttttttttttttttttttttttttttttttttagaaaagtagaaggtagttatcgggttagaggttgtagggttagtttgtgggcgaggtttttttaggtttttgtggagaaacgggaaatttgaggggtaaacgtaggaagcgggttgggttaattgcgggcgatcgaggcgtcgttagcgggtggggagcgagaggggttagtagtcgggaagatttcggtttggagcgtttcgtgttttcgggtttgttggcggcgttgtaagtttaggttttggggcgcgagttaagttttttttgttagttttaaataaaattcgggggagaatgagtcggttagtttgggtatagggtgttttcgattgtcgggcggcgggcggaagcgtaggggttttgatcgtttttagaggtgttgagcgtatagggtagtggttgtagagtttcggcgcgaggttaattcggattatttacgttgggattttagtttgttcggttgtttttagtaataataatagtatgaaatcgagttttaaaaaattttttttcgtatttttttttatgtataagggagaataagtatttttaggtagttaaagaaaaaaaaagggtaggattttaggaaattttaatttttatggacgaggagtgaaggggaattcgttttttgttttttttgtttgtttgtttttagaagagaaaaaaaggaaattcgatatatatttttaaaaatttttttttaataatcgttaaaggttgtgagtgtgagtagagagttaggaaatcgagttttcgttcgcggtgatatcgggtttttgtttttttttttgaagttttcgcgattgttgatcgtgtagagataaaggtcgggttagggttttgtggaatttcgagggaggggcggcggggtcgttttattggttttttttaattttatgtaggggggttaggtgggtttagttgattttcggaataggggttataaggttaggggttgtttttatttttaggtttagacgaggtacggatttgtttttttttattttttcgaaaggtttttgtcgttaaattttttgtattttgtttttattagtattatattgttttatttaaagtttttggaggcgttagggatagtggttttttatcggattcgatttttagaaatggaatcgtgtttaatttttgtggcgattttggttttcgcgatcgttgggttcggttggtcggttagattcgaattcgtgtatcgtttgttttagttgcgttttttaggggcgtttttgtgtttttttcgggtcgcggagatttttttagcgttcggtttcgaattttttgcgtaacgtttttttgttagtcgtacggttttgtagagaaggcgggagagtgtttgtgattttgttttgtagttttcggtgatttaaaaatttaggtcgttgtggaatttagtttttacggtattgtttttgtaggtagtagttttgggtttatatttgaggtcgttttttttatagatatttttgggtgatgcgagtgttgcgtagtttagaatttttggaagtatgagaggaggacgagttcggcggtttgtcggtgcggtgatggagggtttttcggtagttatattgcgcgttttttatatatattttaatagttttggggtttcgggttagcgttgtagtttaaagagattttgtagtcgtatttttttttaggtcgtggtaaattttggtttcgtttttttttattatggtttgtgagggtaggaggttttcgggggtcgatttttttgatttgaatgagttaggtatttttttttattttaagtgggggtgtgatttgaggagataaaggaaggacgatagatttggggagtggggttttgtagttttttgggttcggagcgtattttttttcgttttttttttttatcggtaggatcgggggttttgaaattggagtcgtttatcggtcggcggatgagagataaaggagttcggcggcgtcgaagcgttgattagtagattcggattcggattttttcgcgttttagagtagtattcgaaattttattttttaggtggtatcgacggttgagtagttttttcggtgttatacggtgtttttaggtatagatagtcgtgttcgcgtgtgtattgtgtacgtataagattgtaggatgatgttttgtatgagttttgtattagtttttttgtttttagttagaggtatacgtatacgtgtgtgtatttgttaagtgtttagggataggtgtgtatttttatatatacgtgatgtgtatgtgtatatatttgtagaacgttttagtatttattttataggtacgtatagggttggttgtttttaataagttattattatatttcgtatttatataggtttttttagttttggtatgatttttagaattatttcgggaaatattttttttttaaagtttatagatgaggaaataagtaaaaagaatttaatgggtattcgtttgtatatattgtgagagagatcgaggttagttaaagatttcgtttattgttgaatttgggtgtgttggtcgaatgtgtttatagatgggtttgtttagcgttttaggcgattttaggttcggcgggttttgg

SEQ ID NO: 32 - DNA, 3952 bp, Artificial Sequence
  chemically treated genomic DNA (Homo sapiens)
ggtcgtagtcggagaggaataggaatcgtagtggggacgttttggttttcgggtttatagtattcgggacggacgcgtagtagcgcgggtcgggaattgggtattagggcgggatgggtgagaggttttaagggataaggtagggagaagcgtagcggggtgcggggaatcgtacgttttttttttgtttttgttttttatttcgaggcggtagggcgggcgggcgcggtttcgggggtgggcgggttgggcggggcggaggcggggtcgtagtattggttttatttagtttttttcgttcgtagttagagcgagtcgagtcgcggttagtttcggcgggtagggggggcgttggagcgtagcgtagcgtagttttattagttcgtaaagcggatcgagttggaagtcgagcgttgtcgcgggaggcgggcgatgggggtaggtgttatcggtcgcgttatggacgggtcgcgtttgttgttgttgttgtttttgggggtgagtgttagtcggagggggttcgttttttttttcgggattagaatttcgagaagagtcgggcgtcgttattaaggaaatagaatagagtattggggttttagatattgagggtgggtggtgggaaaggatttttgatgtcgggattacgaaggagggtttagggttttcggagcgtagaggcgattttttagggtggagatgagggtaagatcggagtacggatgtcggtttttaggtatcgtagggggcggtgggggagttgggaggggttttttaagagggggtatggggtttttcgatgtttaggtttttcggaagaggatattcgaatgtcgggatttcgaagggattttttttttagtatttcggtttttggagagtcgtgggatagaattaaggcgagagaaggagggggaattggacggggattagagatgagaggggcgagttgggttggggcggggagttcgggacgacgggatggaataatggaggaggtcggagggattggaggtagaggggattcggtaaggataatggggatcggttagataatgggggggaggggcgtcggagggagaggttggggagcgggagagaggttgagaagtgggttagggagggtagaagaggggcgacggcgagggcggtagagagatggaagtagaaggaaaggagatagagcggggcgcggattttgaagtggtcggggtttcgtttgttcgttgagggatagtgagacgagaagagagagtagaggtttggatatttttagcgtttgttttcgcgtttttgttcgcggttttttttagtttcggaattggggttgcggatttaaggttgggaggggagtgtttatttcgtcggggcgaattcgttttcggggtttttttacggtcggcgggttttttcgacgcgcgtgtttttacggtttgaagtagcgtagcggatcgcgagggacggagcgggtgtgtttttattcgggttggcggtggttacgtttcggggtgtagagcgtcggggcgtattaggcggggattttttttggtcgcgcgtagttttggttacgtaggcgggaggcggtaggtagggggcgttgcggggcgaggtaagtgtagttcgtcgttgtttgtttgcgagtttggggttgcgcgtcgttttttatttagttgcgcgattcgagcgtcgcgtttatcgcgtttcgtgggttttcgcgtttcgaagggtcgggattcggtttgagttttttttggttttcggtgtaagtcgttgggtatttaacgagacgggggcgttcggacgtttcggattttgtagcgcggtatttcgggttatcgattcggtaaaggtcggcgggtttttcgggtggttcgacgagattgttagatgtggtttgttttatggttatgaatcgaatgttttggaaggtttggtaacggaggaggcgtttttatttttttcgttagtattttttattagagtattgcgttttaaatttcggttttatagatacggagattgaggttttgagagtttaaacgatttggttaagattttatagtaagttgggttagagtcgtggttagatttttcgatttgatttttagttcggtatttttttatttttttagggggtagtcgttgttttagttcggggttacggttgcgttttttagtagggcggggggggttgatattgtttttagagttcgtcggcggtagagtttgcgggtgaggtgggtagagattttgttcgggtgcgggttttagttcgaaagtttagttttagttttttggagttgttaggatttgtggttgcgttcggggatttgggagcgatcgcgggtacgtttgttgattaacgtcgttggttagagacgttgtttagacgcgggtgggcgagcgtagattaggagagcggggaggagggatcggattttagaggggtaacgatttgggtttcgggtttgggtaagagcgagggttttcgcgcgaagatttaaggaaggaggggagttgggcgtggaggatttgggcgtttgggaaggtgtatttcgataggaatttgtcgtttgtagtttttgcggttttcgttttcgtttcggcgcgcggttgttcggtttgggatggttgtgcgcggttcgagtttttttttgggtcgcggtgagagagagagggttgaaattagagcgcgtttcggcgggtcggttggcgggtcgcgtcggtaatggaggtattttgttatttagacgtttgtaattagagtcgtcgggttggttaatgcgtttaatagggatggaacgagggtagtaaatgggcgtgcgtgagcggtcgggttgagttgggtggatggtggatggggaggtagtttcgcgggggacgggtttttatcgtattgttttagtttagtttggtttaagcgtttcgttttttttttgggggatcgcgtggggaggcgggaataatcgatgtgttgagtttttattaagtgttttgtatttttttggtagttttttttgaattatttaatttttataaggttttagtaaggtgaatttagttatttttatttcgtagttgaggaaatagaattttttagatttttaggttcgagattaggtttttttagtgagttagtggtggcgtttttgttggaatttaggatgtttggtttgggatgtttttttttttatatatgttaggttttttttcgttttttattttttagattatggaaggagtcgtggttttgagagattaaatcgtgttttatgtttttggttttatatatttagatttgagttttttttttatacgtagaggttttgtttttttttaagtttttatgttatattattttgggtaattagtttttttttttttaattttttttttatttaaagggagtgaggggtatgtgttagtgttttttttgggtttgtatcgattttaaaaggttttttaggtgtttgaaaattttttttattttatggcggtgattacggttttatttatttaagagttttttgttgaagttgttggaatggttagggttgattatattgaaatattcgtatggttttaaatatttttaattgtttcgttgttttttttttttttttaattaaaaaaaatgaaaatttttaaaagttaatttatttaaggatttttttattttagttttttgtaagttttgaaatggttaaaataaaaagattataagcgtttttaaaaatgagatgaaattattttgttaaatgtgaaatgattaagtgtaatatatataaattttagggaaatttatttgttatttttataaattaatttttttggatttgattttggagtaattagtttgaatgttagttatttttttttatttggttaaattttttttttttgtttggggtttttttaagatgagatgtttttttgataattaatatttatt

SEQ ID NO: 33 - DNA, 3952 bp, Artificial Sequence
  chemically treated genomic DNA (Homo sapiens)
aataaatgttagttattaaagaagtattttattttaaggagattttaggtaggaggggagagtttagttaagtagggaggggtgattaatatttaggttaattgttttaaaattagatttaaaaggattaatttatagggatgatagataaatttttttgaaatttgtatgtgttatatttagttattttatatttgatagaatgattttattttatttttaagaacgtttgtaatttttttgttttggttattttaaggtttataaggaattaaggtggaaggatttttagatgaattgatttttaagaatttttattttttttaattagagaaaagagagaaatagcgaaatagttgaaagtatttgaaattatacgaatgttttagtataattagttttggttattttaatagttttagtaaagagtttttaagtgaatggggtcgtggttatcgttatgggatgggagagatttttaaatatttggagggttttttgaggtcgatgtaaatttaggggaggtattggtatatattttttattttttttggataggggaggagttgggaggaaaggagttaattatttaagataatgtagtatagagatttgagagggggtagggtttttgcgtgtggagaaggggtttagatttaaatgtgtggggttaaaggtatagggtacgatttaattttttagagttacgattttttttatgatttagaaggtagggggcgggagggagtttggtatatgtaggaaagagaatattttaggttaagtattttgggttttaataaagacgttattattgatttattgggggagtttggtttcgggtttgaaagtttagaaggttttgtttttttaattgcgaagtgggaataattaaatttattttgttaggattttataaggattaaataatttaagagaaattattagggaagtgtaaggtatttagtaggaatttagtatatcgattattttcgtttttttacgcggttttttagggaagaagcgaggcgtttgagttagattgggttggaatagtgcggtaggggttcgtttttcgcggagttgtttttttatttattatttatttagtttagttcggtcgtttacgtacgtttatttgttgttttcgttttatttttattaggcgtattagttagttcggcggttttggttatagacgtttgaatgataaagtgtttttattatcggcgcggttcgttagtcgattcgtcgggacgcgttttggttttagtttttttttttttatcgcggtttaggaagaaattcggatcgcgtatagttattttagatcgagtagtcgcgcgtcgaggcggaggcgggagtcgtaggggttgtagacggtaggtttttgtcggggtatatttttttaagcgtttaggttttttacgtttagtttttttttttttttgggttttcgcgcggggattttcgtttttgtttagattcggagtttaagtcgttgtttttttgggattcggtttttttttttcgtttttttggtttacgttcgtttattcgcgtttgagtagcgtttttaattagcggcgttagttagtagacgtgttcgcggtcgtttttaaattttcggacgtagttataggttttgatagttttagggaattggggttgagttttcgggttggggttcgtattcggatagaatttttgtttattttattcgtaggttttatcgtcgacggattttggggatagtgttaatttttttcgttttgttgggaaacgtagtcgtgatttcgagttgggatagcggttgttttttgaaaaggtgggggagtatcgagttgggaattaggtcggggagtttagttacgattttggtttaatttgttgtgagattttggttaagtcgtttaaatttttagagttttagttttcgtatttgtaaagtcggaatttggggcgtagtgttttgatgaaagatgttggcggggagagtgaagacgtttttttcgttgttagattttttagggtattcggtttatggttataaagtaggttatatttgataatttcgtcggattattcggaggattcgtcgatttttgtcgagtcggtggttcgggatatcgcgttatagaattcgaggcgttcgggcgttttcgtttcgttaggtgtttagcggtttgtatcgagagttaggagaggtttagatcggatttcgatttttcgaggcgcgggagtttacggagcgcggtgggcgcggcgttcgggtcgcgtagttaggtggggagcggcgcgtagttttagattcgtaggtaggtagcggcggattgtatttgtttcgtttcgtagcgttttttgtttgtcgtttttcgtttgcgtagttagagttgcgcgcggttaggaagggttttcgtttagtgcgtttcggcgttttgtatttcgagacgtagttatcgttagttcgggtaggggtatattcgtttcgtttttcgcgattcgttgcgttgttttaagtcgtgagaatacgcgcgtcggaggagttcgtcggtcgtgggggaatttcgggagcgggttcgtttcggcgaagtgggtattttttttttagttttagattcgtagttttaatttcgggattgggagaggtcgcgagtaggagcgcggggataggcgttggaaatgtttaagtttttgtttttttttttcgttttattgttttttagcgggtaggcgggatttcgattattttagggttcgcgtttcgttttgttttttttttttttgtttttatttttttgtcgttttcgtcgtcgttttttttttgttttttttaatttattttttaatttttttttcgttttttaattttttttttcgacgttttttttttttattgtttggtcggtttttattgtttttgtcgggttttttttgtttttagttttttcgattttttttattgttttatttcgtcgtttcgggtttttcgttttagtttagttcgttttttttatttttagttttcgtttagttttttttttttttttcgttttggttttgttttacgattttttagagatcgagatgttgaggggaaagttttttcgggatttcggtattcgagtgttttttttcgaagaatttgggtatcggagagttttatgtttttttttgaaagattttttttagtttttttatcgttttttgcggtatttgaggatcggtattcgtgtttcggttttgtttttatttttattttggagagtcgtttttgcgtttcgggaattttagattttttttcgtggtttcggtattagaggtttttttttattatttatttttagtatttgggattttaatgttttgttttgtttttttggtggcggcgttcggtttttttcggagttttgatttcgggaaagggagcgggtttttttcggttaatatttatttttagaagtagtaatagtagtaggcgcggttcgtttatggcgcggtcggtggtatttgtttttatcgttcgtttttcgcggtagcgttcgatttttagttcggttcgttttgcggattgatggggttgcgttgcgttgcgttttagcgttttttttgttcgtcggagttggtcgcggttcggttcgttttggttgcgggcgggagaggttgggtgaagttagtgttgcggtttcgttttcgtttcgtttagttcgtttattttcggaatcgcgttcgttcgttttgtcgtttcggggtgggaagtagaggtaaagggagggcgtgcggtttttcgtatttcgttgcgtttttttttgttttgttttttagagttttttatttatttcgttttggtatttagttttcggttcgcgttattgcgcgttcgtttcggatgttgtgggttcggggattagggcgtttttattgcggtttttgttttttttcggttgcggtt

SEQ ID NO: 34 - DNA, 2820 bp, Artificial Sequence
  chemically treated genomic DNA (Homo sapiens)
tttaggggataatatttaggtatgttaacggagtttaaaatgttaaggaaattatattataattttgtttagtatattataggttgttaaatcgaaatgttatgttagttaggagtgtagtaatttttattttttggttttatttaattaggaagttttagtagagcgaagtttgttaagcgttcgtcgttagaatttgaaggaattcgagcgagtaagaagagtgtttgatttattttatagaagtttgtttagaaatggaggagttagcgtttattgaagtcggtttcgttttcggttcgtttatatggagtttgattagttttagttatgtttatttcggtttgggagattcgtaaagtgtttttttttttaatttttttgtattattttgaagtttagggaagtaaagagaggggtatatttggattgtaaaattaatgttttttgtcgtttaggagagaagggaatgagagagagagagagatagatagatagagagagagagagagagagagagagagagagagagagagagagagaaattttattgaaatttagtttttttagaatttgtgtgatttggtttttaacgggagattagtgcgattttatggtatttttgttaggaattagcgatttttttgtagttattatttgatttattgttttttcgtttatttttttttataaagttattttttttttattttagtaagatttttttttttaatgatgataaagtttttgttttagtgttttttttaggattggtgtttttttaaaatagtgaatttagaaaattatttcgtttaatattttttaaaattttcgtagttttaatgtaagcgtaagtatgtaaaggttttttgttatatttgtattttttgtttattttagaattattttttattttcgggtttgtaatagttttttttgtttttttggatagaggtgggtggtattaggggtttagggtagtaggaggtgaggggttgaggaggtcgttagggtaggttggtttgtgttggatacgcgtgtttttttgcggagttaaagggtcggggacgggggttttggatttattagagtaattttagtcggtgggcgtttggtagttatttaaggaggtagggaaagtagcgagttttatcgggcgggttacgatgagtagtatgacgggtagtagtagtagttagtaaaagttttcgtaaagtgtttagttgttgtattgtcgcggggatttttatagtattatgattagttcgtgtaattttgtagtagtaaacggttttcgaggaatataggatcgcgggggtcgggtagcgggttattgagtatttcgcggacggcggtagtagaggcggcggcggtggtagtggtattcggcggggaagtagtagttaaattcgcgtatgatttcgagagttttagtaatatttagggattgggtttagtttcggagcgagagggtcgttcgttgagaagttgcgtcggagacgcgggaagttgttgttataaggagggagttttgggaagtcggaggataggaggagacgggagtttaggggtagacgagtggagttcgaggaggtagggtggagggagagttaaggcgtttcgtagttcggtagtcgtttttcgagttttgtcgttcgtatttttttggcgtttgggaagtagtaggtttttagttcgttcggggttacgtgggaagaggtagtcgggttttgattggtggagtaggatgtaggtttcgggagggaggggtcgacgaggaggtgtaaggatgtaaggaggaggcggtcgcggaagttatagatgggttcgttcgttaggcgttggttcgagtggggttaggcggggatggtttaaatgagaagttcgggttttagggtgggttattcgtatatttatatattattcgttttatttttcgttttaggacgttttttatcgaaggcggggttcggattagcgtttttttttcgcgcgtgatttcgggtcgcgagtgcgggtcgcggttgggtggcgttttttcgagttggagatggtgggggcggaggtgttagaggagtagtagtagtagggtagagaggggcgagtcggcgcgggagagggcgttttgttggcgatcggcgttttagcgtgcgggagcgcgtcgtttaggttgtagggggatgtaggttgggaatgtcgcggcggagaggttagggacgtttttttagggatttataggaaagagggtgagaggcgatggtgttagaatcgtttttgtcgatttggaagtaatagtagtattttttataagagcgtgtaattttaaggttgttcgtcgaggtagtttagttatttcggtaggcgttttttttttttttttttttttttttttttttttttaggtttttcgtagtttcgatttagtttaagcgttcgtaggtttgaatttttttttttattattcgtttttttttagttcgtagtttattagtgtgtttatttgggaggtgcggttagatgtgtttggaaggttagattggtcgggataagtggtttgagagaaagagaaaggtttttttgtatacgtcgcgggtgggttgtcgggagtatcggtcgggtagcggcgttcgggaaggggagagcgggttttatttgttggtttaggtagtgattttgcgttttttattcgggtttttgtcggatggtcggtgatttggggcgacgagagaaggtttaattcggtaggagtttttggttttgcgcgttttttttattttttttagcgggaagggtaaacggtatagcgggattcgtttttcg

SEQ ID NO: 35 - DNA, 2820 bp, Artificial Sequence
  chemically treated genomic DNA (Homo sapiens)
cggaaggcgggtttcgttatgtcgtttgtttttttcgttggagagaatgaaagaaacgcgtagagttagagatttttgtcgagttagattttttttcgtcgttttaggttatcggttattcggtaaagattcgagtaaggaacgtagggttattgtttgggttaataaatggagttcgttttttttttttcggacgtcgttgttcggtcgatgttttcggtaatttattcgcggcgtatgtagaggagttttttttttttttttagattatttgtttcgattaatttgattttttaaatatatttgatcgtattttttaggtggatatattaataggttacgggttggagaggagcgggtgatgaggagagggatttaaatttgcgaacgtttgggttgggtcggagttgcggggggtttgggaggagagaggggagaagagagaaggaaggagagcgtttgtcgggatggttgagttgtttcggcgagtagttttggggttgtacgtttttgtgggagatgttgttgttgtttttaggtcggtaagagcggttttaatattatcgttttttatttttttttttgtaaatttttagagaaacgtttttggttttttcgtcgcgatatttttagtttgtatttttttatagtttaggcggcgcgttttcgtacgttggagcgtcggtcgttagtaggacgttttttttcgcgtcgattcgtttttttttgttttgttgttgttgtttttttgatattttcgtttttattatttttagttcggagagacgttatttagtcgcggttcgtattcgcggttcggggttacgcgcggaagaggggcgttagttcggatttcgttttcggtagggggcgttttggagcggagagtgaggcgaatggtatatgagtgtgcgggtagtttattttgaagttcgagttttttatttgagttattttcgtttagttttattcgggttagcgtttggcgagcgagtttatttgtggttttcgcggtcgttttttttttgtatttttgtattttttcgtcgatttttttttttcgggatttgtattttgttttattaattagagttcgattgtttttttttacgtgatttcgggcgggttgaggatttgttgttttttaaacgttagagggatgcgggcggtagagttcgagaggcggttgtcgggttgcggggcgttttgattttttttttattttgttttttcgggttttattcgtttgtttttggattttcgtttttttttgtttttcggttttttagagttttttttttatggtagtagtttttcgcgttttcggcgtagttttttagcggacgattttttcgtttcggggttgagtttagtttttggatgttgttgaaattttcgagattatgcgcgggtttggttgttgttttttcgtcgggtgttattgttatcgtcgtcgtttttgttgtcgtcgttcgcgggatgtttagtagttcgttgttcggttttcgcgattttgtgtttttcggaagtcgtttgttgttgtagagttgtacgaattagttatggtgttgtgggagttttcgcggtagtgtagtagttggatattttgcgagggtttttgttggttgttgttgttgttcgttatgttatttatcgtagttcgttcggtgaagttcgttgttttttttatttttttaagtgattgttaaacgtttatcggttggaattgttttggtaagtttagaattttcgttttcgattttttaatttcgtagaagaatacgcgtatttagtatagattagtttattttagcggtttttttagttttttattttttattgttttagatttttaatattatttatttttatttagagaaataaggggaattgttgtaggttcgggggtgaggggtggttttgggatgggtagaaagtgtaggtgtagtaggaaatttttgtatgtttgcgtttatattggagttgcgaggattttgagaaatattaaacgggatggttttttgggtttattgttttgaaagagtattaattttaggggaaatattgaaatagaagttttgttattattaaagaaaaaagttttattaggatgaggaagaaataattttatgagaaagaatgagcgagaaagtaataaattaaatggtgattgtaggggaatcgttgatttttggtaaaggtgttatgaggtcgtattggtttttcgttgaagattaggttatatagattttagaggagttgggttttaatagaatttttttttttttttttttttttttttttttttttttttttttttttttatttatttattttttttttttttttattttttttttttttaggcggtaaaagatattggttttgtagtttagatatgtttttttttttgtttttttaagttttaaggtagtataggggagttgagaaaaagaatattttgcgggttttttaggtcggagtgggtatgattgaggttggttaggttttatgtaggcgagtcgagggcggaatcgattttagtgggcgttgatttttttatttttggataggtttttgtggagtgggttaggtattttttttgttcgttcgggtttttttagattttgacggcgaacgtttggtaggtttcgttttgttgaagttttttaattaaatagggttagaggatgggagttgttgtatttttagttggtatagtatttcggtttgatagtttgtagtatattgggtagaattgtggtgtaatttttttggtattttaaatttcgttaatatgtttgggtattgttttttagg

SEQ ID NO: 36 - DNA, 3104 bp, Artificial Sequence
  chemically treated genomic DNA (Homo sapiens)
gcgggcgttgtcgagtacggggaggtgttgaaatagttttggcgtgttgatttaagttttgattggtagagttattcggtgattgatagggggtttttatggcgttcgcgtcgttaattcgtttattttaatagcggagttagttcgtttgtcggcgtgtttgagtcgagtcgagttcgaattttaagtcgcggagttagtattttttttagtcggggtcgttcgttttcggtcgttgagttatcgtcgttattcggtagtgtgtttcgttgttttaattcgttttattaataagcgtttggtatatttagttaggttcgcgggtatttgttgcgtgtttcgtttcgggtttagtgttttcgtcgtcgtcggtattgtttcgatgttttagttgtttattttgaattttagtttttagtaagtggtcggggtatgtgagattttggaagagagcggcgatgtggagcgtttgggtcgttttttttggtcgttgttcgtggtttttgcggtttgcgaggtttttaataagaatgagtcggtgttacgcgtacgagttatcgtggttttttacggtggtaattatcgcgagttttattatattttggaaaattataagtttattaaggagtcgtacgttaagttgtaggcgttgtggtttgaagtatattattaggaggttgagaagttgcgtggaagatttttgggatttgtggataagtatcgagtaaggaagaagttttcgttgtcgcgtattatttgggacggcgaatagaagatatattgttttaaggagcgtacgcggtatttgttacgcgagtggtatttgtaggatttatattttaattttagtaaaaaacgtgagttcgtttaggtaatcggattgatttttacgtaggtgggtaattggtttaaaaatcgtcgataaagggatcgagcggttgtagttaagaataggtcggtatttagaggttttcgcgttttgagcgtatcggggaggaggcgggtggaggtatttttggcgtttttatttagtttttggcgattttaatttagtaggagttgggagcgcggtttgttttgggttaagagttttgcgttttgggtttttggtcgggagtttttttgtcggttttgtttttttattcgttggttttttacgtttgcgggtagttgtagtagttggtttcggttattaaattaaggttttattgggacggagaggggaagagaaataaaaaattaaaattttataaatagttagggattttaagatttaaagttaatttttgttagtttgggtataggtttttattattaatcgaagtttggtttattagtaatgtgtcggttttatgttaattattatttttaaagtttaggtatatttttttttaatgttttgaaaatagtttttaatggatttttgagaaatgggaagtcgagtttttttttttttatgcgttgtttgttatttttgttttaaaatagtaaattagttcgtgggtcgaggtttttcgtttttcggagtgtggatttcgattagttaaatattttgcggaagagttcggttttattttttaggtttaaatgttttttataattttttttgtttttaggtcgggtcgattcgatttaacgcgatcgcgggagtatttgtttaggcgtaagttttaggtagacgtatcgttagaaatggtattttatgtttttgggatcgatttgtttttgttatttatatttcgtttattttttgatagttttgtaaattttttaaaagtgtataataaatagggaggatattgtaagtttagtatataaaagatttgggagttgcggcgttgagaaagggcgcgaattatggtggggtataatagtagggattcgcggaggggcggtcgcggatttttgttcgatttttgtcgttttgtcgagtaattttcgttttaattgttggggttttcggaagaatttttagtcgtcgggttggagggacgtaggaggtggtgggggcgggcgacgggcggttgtgttacgagttgtgattcgtgttttttttttttttcgtagattttagtagtaggttttgttatagggtttcgggcgggtattacgggcggagggcgacggtacgttagaggtgttgggcgtcgttattagttcggtcgttagtttatttagtaaggcggttattttagttatttttattacgtttagcgatagcgagtgcgatatttgagttgtttatttaggatgtttagaagtagattttagtgtaaaaacgagaaaaataaaatgaaagaggggaagaagatgagagatttgtaaatttagcgttatagaagttaggtgattagggattcgcgggttcgggttgtcgtttttcgttttatttcgcggtcggtttggttttattggcgttttttggtcgcgattacgggaattagcgtgaggtttgatttagtattacgttttttttgttttgtttttttttaaggattttgttgtaaagttttttcggaattcgaattgtaagttgagcgtttgtttagatttttttatgggtattttacgtcgaaaggacgttgttatatatgtataattttcgttttaaagtttttttttaataaaatatatatatgttgtttatttatttatttaagagatcgttatggtaggtttttttgtagtttggggaatttgttgtttttaaatatgtaggttggtggtgatgggttttgtgtggagaagttaaataataaaataatttagtgggtaatttttttaattaagggagttgtttttagattttttttttttttattattattaatattattttttttattaggtatgtagggatttttgagtaaatggttttcggaaggttttatttatatattttttgttttttttggtgttttttggtatatgttttaaataatttatggtaggtttataattattttttacgttaaattatacgtatgtgtatatatgtatgtatttatataaatatatgtatgtatttatataaatatatgtatgtatgtatatacgtgatatatttaaggttagaaattggtaatatgtgagcgtttttttta

SEQ ID NO: 37 - DNA, 3104 bp, Artificial Sequence
  chemically treated genomic DNA (Homo sapiens)
tagagaggacgtttatatgttgttaatttttagttttaaatatattacgtgtatgtatatatatatatgtttgtataggtatatatatatgtttgtataggtatatatatatatgtatatacgtgtaatttgacgtgggaggtggttatagatttattataggttgtttaaaatatatattaggaagtattaaagaaggtaaaagatatataggtaagatttttcggagattatttgtttaagggtttttgtatgtttggtgaagggaatgatattaataataataagaagaaaaggaatttgagagtagtttttttaattaagaaggttgtttattaggttgttttattgtttggtttttttatatagaatttattattattagtttgtatgtttagaaatagtaagttttttaagttatagagaaatttattatggcggttttttaaataagtaaataaatagtatatatatgttttgttaaaaaaaaattttaaagcgaaagttatatatatgtaatagcgttttttcgacgtgaaatatttatgggagaatttgggtaggcgtttagtttgtagttcgggtttcgaagagattttgtagtaaaatttttaggaaaaagtaaagtaagaagaacgtggtgttgggttaggttttacgttggttttcgtggtcgcggttaaagggcgttagtgaagttaggtcggtcgcggggtggggcgggaaacggtaattcgagttcgcgggtttttggttatttggtttttgtggcgttggatttgtaggttttttatttttttttttttttttattttgtttttttcgtttttatattggaatttgtttttgagtattttggatgggtaatttagatgtcgtattcgttgtcgttggacgtgatggagatggttgaagtggtcgttttgttggatagattggcggtcgggttggtggcgacgtttagtatttttggcgtgtcgtcgtttttcgttcgtagtgttcgttcggaattttgtgataggatttgttgttggagtttacggggaagaaagggaatacgggttatagttcgtaatatagtcgttcgtcgttcgtttttattattttttgcgtttttttagttcggcggttagaggttttttcgaagattttagtagttaaggcgaggattattcggtaaggcgatagaggtcgggtaggagttcgcggtcgttttttcgcgggtttttattgttgtgttttattatgattcgcgtttttttttagcgtcgtagtttttaggttttttatatattgggtttgtagtgttttttttgtttgttgtgtatttttgggagatttataggattgttaggaaataaacgaagtgtgggtgataaggatagatcggttttagggatatgggatattatttttaacggtgcgtttgtttggggtttacgtttgagtaagtgttttcgcgatcgcgttggatcgggtcggttcgatttaaaggtaaaaaggattgtaaggagtatttgggtttgggggatgaggtcgggttttttcgtaaaatgtttggttaatcgagatttatatttcgggaaacgaaaagtttcggtttacggattagtttgttgttttgagataagagtggtaggtagcgtatgggaagaggaaaattcgattttttattttttaaaagtttattgaaaattgtttttaaagtattagggagggatatatttgggttttgaaaatgataattaatatgaaatcgatatattgttaataagttaggtttcgattaatagtaggagtttgtgtttaggttgataagaattagttttgggttttggggtttttaattgtttgtaggattttaattttttattttttttttttttttcgttttagtgaagttttggtttggtgatcgggattagttgttgtagttgttcgtaggcgtggggagttagcgggtggggaagtagagtcggtaagggaattttcggttaggagtttagaacgtagggtttttaatttaagatagatcgcgtttttaatttttgttgaattggagtcgttagggattgggtaagggcgttagaggtgtttttattcgtttttttttcggtgcgtttaaagcgcggaggtttttaggtatcgatttgtttttggttgtagtcgttcggtttttttgtcggcggtttttgaattagttgtttatttgcgtaggggttagttcggttgtttgggcgagtttacgttttttgttggggttagggtatggattttgtaggtattattcgcgtagtaggtgtcgcgtgcgttttttgaagtagtgtgttttttgttcgtcgttttaaatggtgcgcggtagcgggaattttttttttattcggtatttgtttataggttttaggggttttttacgtagttttttagttttttggtagtgtgttttaagttatagcgtttgtagtttggcgtgcgattttttggtgaatttgtggttttttaggatatgatagagttcgcggtagttgttatcgtgaaaggttacgatggttcgtgcgcgtagtatcgatttatttttgttgagggtttcgtaggtcgtaggggttacgggtagcgattagaggaagcgatttaggcgttttatatcgtcgtttttttttagggttttatatatttcggttatttgttgggggttgaaatttaagatgggtagttggaatatcgaggtagtgtcggcggcggcgagggtattgagttcggagcgggatacgtagtagatgttcgcgggtttggttgagtgtgttaggcgtttgttgatgaggcggattggggtagcgggatatattatcgggtggcggcggtggtttaacggtcgggagcggacgatttcgattggaggaggtgttggtttcgcggtttggggttcgggttcggttcggtttaggtacgtcggtaggcgagttggtttcgttattggggtgggcggattggcggcgcgggcgttatggagattttttgttagttatcgggtggttttgttaattaaagtttgaattagtacgttaggattattttagtattttttcgtgttcgatagcgttcgt

SEQ ID NO: 38 - DNA, 2378 bp, Artificial Sequence
  chemically treated genomic DNA (Homo sapiens)
attttgagattttagttgattttttttgttttgtaattagaggggattgtgatttgggttaattttttttttatgggttttagtggagttagttgtggaatggaatattaatttttattttataggtatgttgtgaggtttcgttaagaaatagttataaaagggttttaagagttatgatgattgttttaattatttagtagggagggggtatttagcggtgttgtttttacgtatcgatgttacgtggggcggggaggcggggcggagaacggagagcgtttttttattttttattttttttttttaagtttagcgtagggggaggtggttgcgattgattgaggggttagggaaggttggttaggggcgtgggcgtggttggggacggtttgggggtggggttgcgtaggaggttggaggagtttcgcgggatttagaggcggggcgtcggttcggggattattgttttttcggggcgtggttgtaggaggttggaggagtttcgcgggatttagaggcggggcgtcggtcggggatcgttgttttttcggggcgtggttgttgtcgagtattttttagtttagtcgagttcgtgtttaggttacgttttgttttagtcgtcgttttttttattttacggcgttcggagttatttttcgtttgttcgtttttttttttcgtttattttttgtatttgggtttgtattatttttgttaatcgttttttcgattttgtcgatattttttttttaaatttttgatcggtatttttgtttggtatttttttttttatttttttttttttatttttttttttcgatttttttcgggtttttttttttttaaaattcgggttttttcgcgtggtttcgtttttaggtcggggatgtttttcgcggtttcgcgtttatggttttgacgttgttttttttcgtttataagttgtgtcgttttttcgttatgtcgggtttacggcggggcgtcgagcggttggcggtgtttgggttagatgggggcggtggtacgggtttatggtgggttgcgggtggttcgggttcgcgaaagtgtcgtcgggggtaggtatcgaggtgtaggacgttttggagcgcgcgttgtcggagttgtagtaggttttgttcgcgttgaagtaggcgggcggcgcgcgggtcgtgggcgtcggtttggtcgaggttttttaattggtggaggaggtttggttgttgcggtcgtgggtcgcgaggtagtttagggtttgtgcgacgttattcgtttcgatggcggtttcgatttgttgttgcggttgttgtaggcgtcggagttggagacgcgtgtgtaggtcgcgcgtttgttggagtagattttggtggttgagaatcggtgagcgcgttaggtcggggttgggagagcgtcgcgtggtgtggatagttaagcgtttgcgttttcgtgtgttttgcgtcgtgtttttgttttttttatttttttgattgtttgtattatatttttgttaggggttagtttgtttgttttatagataaggaaattgagttttgggaaagtttagtgatttgtttagtggattatagtgaattaagatttgtttttagggttagtggggtgaggaatggagttataggataggagttcgtttttggttttatggatggagatggtattttattgttaattttttttttttttcgttttttaagtttatagtttttttttttatcggtttgggttttcgtttatgatattttttttcgttattattttattttttttttaatgagagaagaagggaaatataacgtttagaaaagagggagggagatttttttttttttttttttttaggttgtaaggcgtgttggtttgaggttgtttattttttttttgtcgttttaatttaatttttgttttattttttattttggtttttgtaataggttagatatgattttattttgtagttgttgatgggaaatagttttttgttgggaggtatgggtgggggaagaggatatcggggtgtagagttcggcggggattaggtagagtgtgtgttttttttttttattttatttagtattaagatgtcgtaagagggttaaatagaggtttggttgttatttttgtatgttttttgggattttttttggagtatgaagatttttaaggatttatttttttttttttttgatgttagagtagattaagttgttatattttagttttatgttgaagtttttagttttttaagtttagaagagtttttggaagagttatttttagtttatgtagtttttataagtgtgaagggagtgggttgggggtgttttttttgttattttcgaaaagaaaaaaattatttggtg

SEQ ID NO: 39 - DNA, 2378 bp, Artificial Sequence
  chemically treated genomic DNA (Homo sapiens)
tattaggtaattttttttttttcgaaaatggtaaggaaaatatttttaatttattttttttatatttgtgagagttgtatgagttgaaagtgatttttttaaaaatttttttaagtttgagaagttggagattttagtatgagattggagtgtgatagtttggtttgttttggtattagaagggagggaaagtgagtttttggaggtttttatattttaggagagattttaagagatatgtaagagtggtaattaggtttttgtttgatttttttgcggtattttggtgttaagtggggtgaagggagagaatatatattttgtttggttttcgtcgggttttgtatttcggtgttttttttttttatttatgttttttagtagaaaattgttttttattagtagttgtagaatgagattatgtttggtttgttgtaagaattagaatgaaggatggagtagaagttggattggggcggtaagaagggagtaagtagttttaggttagtacgttttatagtttggggaggagggaaaggagaggttttttttttttttttttgagcgttgtgttttttttttttttttattgggagagggatgggatgatggcgagagaaggtgttatagacgggaatttaagtcggtgggaaggagagttgtgggtttggggggcgggggagagggagaattggtaataggatgttatttttatttatagagttagggacggatttttgttttgtaattttattttttattttattagttttgggagtaaattttagtttattgtgatttattgagtaagttattaaatttttttaaggtttagtttttttatttgtgaaatagataggttgatttttaatagagatgtagtgtaggtagttagagaggtgagggaggtaaaggtacggcgtaaggtatacgggaacgtaggcgtttaattgtttatattacgcggcgtttttttaatttcggtttggcgcgtttatcggtttttagttattaggatttgttttagtaggcgcgcggtttgtatacgcgtttttaatttcggcgtttgtagtagtcgtaatagtaggtcgaggtcgttatcgaggcggatggcgtcgtatagattttgggttatttcgcggtttacggtcgtagtagttaggttttttttattagttggaagatttcggttaggtcggcgtttacggttcgcgcgtcgttcgtttgttttagcgcggataaggtttgttgtagtttcggtagcgcgcgttttagggcgttttgtatttcggtgtttgttttcggcgatattttcgcgggttcgggttattcgtagtttattatgggttcgtgttatcgtttttatttggtttaggtatcgttagtcgttcggcgtttcgtcgtgggttcgatatggcgaagaagcgatatagtttgtaggcggagagaagtagcgttaggattatgggcgcggggtcgcgggggatattttcggtttggaggcggggttacgcggagagattcgggttttgggaaaagagggattcgagaggggtcggggaaagaagatggagggggaggaatggagagaagggtattaggtaagggtgtcggttagaagtttgggggaggagtgtcggtaggatcgggggagcggttggtaaaggtgatgtaggtttagatgtagggagtgggcgaaaggagagagcgagtaggcgagggatggtttcggacgtcgtagggtagaggaggcggcggttggaataaagcgtggtttgggtacgggttcggttgagttgggagatgttcggtagtagttacgtttcggaggagtagcggttttcggtcgacgtttcgtttttgggtttcgcggggtttttttagttttttgtagttacgtttcggaggagtagtggttttcgggtcgacgtttcgtttttgggtttcgcggggtttttttagttttttgcgtagttttatttttaagtcgtttttagttacgtttacgtttttggttagttttttttagttttttagttagtcgtagttatttttttttgcgttggatttggaggaagggggtggagaatgagaggacgtttttcgtttttcgtttcgttttttcgttttacgtgatatcggtacgtgggagtaatatcgttggatgttttttttttattaaatggttaaaataattattataatttttaaggtttttttatggttgttttttagcgaaattttataatatgtttatggggtgggaattgatgttttattttatagttgattttattgaagtttatgaggaagaaattggtttaaattatagttttttttgattatagaatagaaaaagttagttaaaattttaggat

SEQ ID NO: 40 - DNA, 2436 bp, Artificial Sequence
  chemically treated genomic DNA (Homo sapiens)
agttttggatgataaggattaattgtttagggcgttggtcgagaggaataggaagagcgtttcgtggagtagggcgggcgagaagagtcgggcggtcgcggggttttcgcgtatgttgggtaggaagaggaagagttgtagtacgaaggttattagggagatgtataagaagtaggcgggggttattacgttgagtagtcgtagggttagtattttcgattatatttttgcggggttcggggtgagaagaggattgattgattacggcgtttagggggcgttttcgttcgttttttcgtgtcgcgcgtttggggtattgtacgcgattttacgtttttaattttttgtttcgcggattttttttttttagttttttaatttcggattaggtaggttagagattcgagttcgtagcggtttcgggtttaggttttatttgggggtgagtgttgtttggggttttgagcgagttcggcgttttggcgcggtagagtttggtataggagggagggattcgtttgtagtttttaggagttgtgagggtggggggtatcgggggataggattttttttttttgtggatgtggaaataagtttaggtttgggatttttggtttagatttttttaggaggagaaagggaaggatttggggtcgggggtaggagaattagcggtatttgatttgttggaaattttgttttatattttttttttttcgtttttgcgtttttatttatatatatattttgggtagtatttagggattttattaggttatttaaggttttttggaggtatgtgtgcgtgagggattacgatgtgtgtgtgtgtgtttttgtttgtgattttgtacgtgtaatttgtgtgcgtttgagtatttgtatttgtgtatgtatatatttgcgtgtatagatacgtagtttttgttatttagttttaaaaaaattaattgaaataatcgatatatttatattcgttttcgggtatcgggtgaggtgggggcgtaattagaatatttgtgttagcgggttttggttagtatatttttttaacgttggttgttcgggttatttttttgcgaagagcgtttttatttgaggcgaaattaaaatttttttttcgcgttcgtttttcgtttttttgttgagagaaatttaaataatttttatggcgtcgaaattttttttatgtcgataagttcgttttgggcgtacgagtggatgtttggttagttttttttgggatcgatttcgtcgtcgtgtttagtttttattacgtttttattttattttacgttttatagtcggggtttttggttagtttcggaagttatcgagaaataggatttcgtgcgttcgagagaatttttttaggggttaaggaatcggttagtcggaggcgcgagaaaagttttgggaaggcggttgtatttaggatgggtggatgttacggggttttcgtttaggttgtttcgttcgtacgggtcgattggttattttggaattttttttgtaggttttagcgtttttcgggaattcgtagttttcgcggagagcgtgggtttttttttatcgttggggcgtagcgtagtgtacgtttgagggtggtcgtcgggggttgggtacgtttttagttttgcgtcgtcgggggttgcggcggtgttgtttattttagagagttttcggtttggggtttcggcgaagtaagtgttttttcggcgtcggtcgttaggggggcgcgggagtagttagatgcgtcgtagcgttgggaaggcggcgaaggataggggttaggggagtgaggggcgttcggtaggtagttttagttttggttttgcgcgggagaagggatagtagagatcgttcgtggggtttcggggtgtagggagttgttcgtttagttttggcgttcgtttcgttcgcggtagagggcggtatagtcggagttttggaaagatcggtagcgtcggtagtcgcgggtttttcggttattgtttttcggacgtacgggaagtcgtttttcgcgtcgtcgtcgtcgtattgtcgtcgtcgtagaggggtgaggaaattaatttatcgagttttggtcgtcgataagaggagtttcggacgtcggttttcgttttgttcgaggttgtaaagttgtggattcggttcggttggttcgtagtttgcgtttcgtttcgggaattgggtaagtagcggggatgtggggaggagggagcgggtagttgttggttttttatttgggcgttagcgagtaagggttaggaagcggcggggatggtagttgggtattttttagtttcgttattttttttttcgtttttgggggcggtgttttggtcgttagttttagtatcgtggatttgttttttttttttttttcgattttttttgagcgggttggggcgttttgtttggttttagcgttcg

SEQ ID NO: 41 - DNA, 2436 bp, Artificial Sequence
  chemically treated genomic DNA (Homo sapiens)
cgggcgttgaaattaggtagggcgttttagttcgtttaaggggaatcgagaggggaggagggggtaagtttacgatgttgagattggcggttagagtatcgtttttaggagcggagggaggggtggcggggttggggggtgtttagttgttattttcgtcgttttttggtttttattcgttggcgtttaagtgggaagttagtagttgttcgtttttttttttttatattttcgttatttgtttagttttcgaagcgaagcgtaggttgcgagttagtcgggtcgagtttataattttgtagtttcgggtagggcgagagtcggcgttcggggttttttttgtcggcgattagagttcggtgagttgatttttttatttttttgcgacggcggtagtgcggcggcggcggcgcggggggcggtttttcgtgcgttcgggaggtagtggtcgagaagttcgcggttgtcggcgttgtcggtttttttaaggtttcggttgtgtcgttttttgtcgcgggcgaggcgggcgttagggttgaacggatagttttttatatttcggggttttacgggcggtttttgttgttttttttttcgcgtagggttagggttgaggttgtttgtcgagcgttttttatttttttagtttttgtttttcgtcgtttttttagcgttgcggcgtatttggttgttttcgcgtttttttggcgatcggcgtcgggaaggtatttgtttcgtcggagttttaggtcgagggttttttggggtgggtagtatcgtcgtagttttcggcggcgtaggattgggggcgtgtttagttttcggcgattatttttaggcgtgtattgcgttgcgttttagcggtagggagaggtttacgtttttcgcggaggttgcgggttttcggggggcgttgggatttgtaaaggggattttaaggtgattagtcgattcgtgcggacgggatagtttggacggaggtttcgtggtatttatttattttaggtgtaatcgtttttttagaatttttttcgcgttttcggttggtcgattttttagtttttggaaaagttttttcgggcgtacggaattttatttttcggtggttttcgaagttggttaggaatttcggttgtgaggcgtggggtgggatggggacgtggtgagggttgagtacggcggcggggtcgattttaggaaaggttggttaagtatttattcgtgcgtttagggcgggtttgtcggtatggaaaggatttcggcgttatgagggttgtttgggttttttttagtaggagggcgggaggcgggcgcgaaggggggattttaatttcgttttaaatgaaaacgtttttcgtaaagaaatagttcgggtagttagcgttggagagatgtgttggttaggattcgttgatataggtattttggttgcgtttttattttattcggtgttcgagagcgagtgtgagtgtatcgattgttttaattgatttttttaaagttagatagtagaggttgcgtgtttgtatacgtagatatatatatatataaatatagatatttaagcgtatatagattatacgtatagagttatagataaggatatatatatatatatcgtggttttttacgtatatatatttttaaagagttttgggtaatttggtgaggtttttgagtgttgtttaagatgtgtgtgtgggtggggacgtagggacggagaaaggggagtgtgaagtaggatttttagtaggttaagtgtcgttgatttttttgttttcgattttaaatttttttttttttttttttagggaggtttgaattagaaattttaaatttgggtttgtttttatatttatagaggggaggagttttatttttcggtgttttttatttttataatttttaaagattgtaaacgagttttttttttttgtgttagattttgtcgcgttaaggcgtcgagttcgtttaaaattttaggtaatatttatttttaggtggggtttagattcgaggtcgttgcgggttcgggtttttggtttgtttgattcggggttagggaattggggaggggaaattcgcgggatagggggttgggggcgtggagtcgcgtgtagtgttttagacgcgcggtacggaggagcgggcgagggcgttttttggacgtcgtagttagttagttttttttttatttcgggtttcgtaggaatgtaatcgaggatgttggttttgcggttgtttaacgtggtggttttcgtttattttttgtgtatttttttggtgattttcgtgttgtagttttttttttttttgtttagtatgcgcgaggatttcgcggtcgttcggtttttttcgttcgttttgttttacggggcgttttttttatttttttcggttaacgttttgggtaattagtttttgttatttagaatt

SEQ ID NO: 42 - DNA, 2804 bp, Artificial Sequence
  chemically treated genomic DNA (Homo sapiens)
ttaaggtttgttggatttgaggttgtttggggtgttaaatagatttatttatgagtatatttggttaatatatttaagtttaatagtgggtgggatttttggttggttttgattttttttatagtgtgtgtaaatgggtatttattagattttttttgtttgtttttttatttgtaaattttgaaaggagagtattttttggggtgattttgaaaattatgttagaattgaaaaggtttgtgtaaatgtgaggtgtaatgatgatttattagaagtagttagttttgtatgtgtttgtaggatagatgttagaatgttttataaatgtgtgtatatatatattatgtatgtgtgaaggtgtatatttgtttttagatatttgataaatgtatatatgtatgtgtgtatttttggttgagagtaaaggggttaatatagggtttatataggatattattttgtagttttgtgtgtgtatagtatatatgtgagtatgattgtttgtgtttggagatattgtatggtattggaggagttgtttagttgttggtgttatttgggaagtagggttttgggtgttgttttggagtgtgggaaagtttggatttgggtttgttggttagtgttttggtgttgttgggtttttttattttttatttgttggttggtgagtggttttagttttaagatttttgattttgttggtgaggggagggagtgagaaggagtgtgttttgggtttaagaggttgtagggttttattttttaggtttgttgttttttttttatttttttaggttatatttttatttaaaataaagaagggtgtttgatttatttaggttagggaagttggtttttgggagttttttgtttttataagttatggtgaagggaggtgaagttagggtttgttatggtttgggagaaaatgtggttgtagggtttttttgggttgtagtgttggtttggggttttaagattgttaaggtgtgtgtgggaggtgtgtagtgtggttattgaagagttttttattattgtattggtaggttgttgggtttgttttttttttatgtttttaagggttttgagttgtgtagtatttgtattatttagaagtgtttgtggagaaaatgattttaggtgtaagtttaaggttgttgtttgtaaaggtaatgttgtggagattgggttttatagtgatttgggtttttaagttattgaaagttatagggtagggttataaatatttttttgttttttttgtagaattgtgtggttgataggagagtgttgtgtagaaaatttgaggttgggtgttggaggagtttttgtggtttggagaaggtatagaggtgtttttgagaggtgtagttggaataggtgatgtatgggtttggatttggttggttaattgagtttagtggttgtgaaaattagagttgttatagaggttgagtatgattttatttttggggattgggtttggtggggagttattgtttttaatgtttttagagattttaagtaggataatataatgttggtaggagtaaggtgtaaggaatttagtggtagaagttttttgggggggtggggaaaggtagatttgtgttttgtttgagtttgggggtggggatagtttttggttttgtagtttttgttttggggattagttgggtttatttaatttttttatatggggttgaaaggggttaatgggatggttttgttgttttttttttgggattttatagggttttgatttggtttttatttttgtatggttagtagttgtgggggttttaggaaggaggataaaggtttggtgttattgtgggtgggggtttggttttttggttttttgtttatatttatagtttttagtggttgttgggggaagatttttaaaaatatgtgttgaatttttttttttttttttttagaaataaataaataaaaaaggtaaaaggtgaatttttttttattttttgtttatagagattaaagttttttgggattttgttttttttttttttttgattgtttagaaatatttgtttttttttgtatatagaggaaaatgtggggaaaggttttttaaaatttggttttatattattattattattaaggataattgggtaggttgaggttttaatgtggatgatttgagttggttttgtgttggggttttgtagttattgttttgtgtgtttagtatttttgggggtgattagggtttttgtgtttttgtttgttgtttggtagttgagagtattttgtgtttagattggttgatttatttttttttgaattttgtttagagttggtaagggggatttagtttgtgttttaagatttgggtttgtagtgttgttaataggtttggggatatgaggtgttttaggttggggtttttttggttgttggttttttttgttttttatttgttggtggtgttttggttgtttgtaattgatttaatttgttttttgtgtttgttttttaggttttttgtttttttataaaggtttaggggagttttgtttataggttgattttgtaatttttggtttggtggttattttttgtttttttgaaaaagaaaaggaaaaaaaaaaaaaaaaagaaaaaattaattagttgagggaggtgtgtgaggattggaggtgttagttggatagtttatgagtaggtttttgggttggtgttgttttgtgggttagtatggttttttttagagaaaattttttaaatgtgtgaagattgttttgggggaagtgagagggaggttggaggag

SEQ ID NO: 43 - DNA, 2804 bp, Artificial Sequence
  chemically treated genomic DNA (Homo sapiens)
tttttttaattttttttttgttttttttaaagtggtttttatatgtttaggaggttttttttgagaaaggttgtgttgatttgtgaagtggtattgatttagggatttatttataggttgtttggttggtgtttttagtttttatgtgttttttttgattggttgatttttttttttttttttttttttttttttttttttttagaaaagtagaaggtagttattgggttagaggttgtagggttagtttgtgggtgaggtttttttaggtttttgtggagaaatgggaaatttgaggggtaaatgtaggaagtgggttgggttaattgtgggtgattgaggtgttgttagtgggtggggagtgagaggggttagtagttgggaagattttggtttggagtgttttgtgtttttgggtttgttggtggtgttgtaagtttaggttttggggtgtgagttaagttttttttgttagttttaaataaaatttgggggagaatgagttggttagtttgggtatagggtgtttttgattgttgggtggtgggtggaagtgtaggggttttgattgtttttagaggtgttgagtgtatagggtagtggttgtagagttttggtgtgaggttaatttggattatttatgttgggattttagtttgtttggttgtttttagtaataataatagtatgaaattgagttttaaaaaatttttttttgtatttttttttatgtataagggagaataagtatttttaggtagttaaagaaaaaaaaagggtaggattttaggaaattttaatttttatggatgaggagtgaaggggaatttgttttttgttttttttgtttgtttgtttttagaagagaaaaaaaggaaatttgatatatatttttaaaaatttttttttaataattgttaaaggttgtgagtgtgagtagagagttaggaaattgagtttttgtttgtggtgatattgggtttttgtttttttttttgaagtttttgtgattgttgattgtgtagagataaaggttgggttagggttttgtggaattttgagggaggggtggtggggttgttttattggttttttttaattttatgtaggggggttaggtgggtttagttgatttttggaataggggttataaggttaggggttgtttttatttttaggtttagatgaggtatggatttgtttttttttatttttttgaaaggtttttgttgttaaattttttgtattttgtttttattagtattatattgttttatttaaagtttttggaggtgttagggatagtggttttttattggatttgatttttagaaatggaattgtgtttaatttttgtggtgattttggtttttgtgattgttgggtttggttggttggttagatttgaatttgtgtattgtttgttttagttgtgttttttaggggtgtttttgtgttttttttgggttgtggagatttttttagtgtttggttttgaattttttgtgtaatgtttttttgttagttgtatggttttgtagagaaggtgggagagtgtttgtgattttgttttgtagtttttggtgatttaaaaatttaggttgttgtggaatttagtttttatggtattgtttttgtaggtagtagttttgggtttatatttgaggttgttttttttatagatatttttgggtgatgtgagtgttgtgtagtttagaatttttggaagtatgagaggaggatgagtttggtggtttgttggtgtggtgatggagggttttttggtagttatattgtgtgttttttatatatattttaatagttttggggttttgggttagtgttgtagtttaaagagattttgtagttgtatttttttttaggttgtggtaaattttggttttgtttttttttattatggtttgtgagggtaggaggtttttgggggttgatttttttgatttgaatgagttaggtatttttttttattttaagtgggggtgtgatttgaggagataaaggaaggatgatagatttggggagtggggttttgtagttttttgggtttggagtgtatttttttttgttttttttttttattggtaggattgggggttttgaaattggagttgtttattggttggtggatgagagataaaggagtttggtggtgttgaagtgttgattagtagatttggatttggatttttttgtgttttagagtagtatttgaaattttattttttaggtggtattgatggttgagtagtttttttggtgttatatggtgtttttaggtatagatagttgtgtttgtgtgtgtattgtgtatgtataagattgtaggatgatgttttgtatgagttttgtattagtttttttgtttttagttagaggtatatgtatatgtgtgtgtatttgttaagtgtttagggataggtgtgtatttttatatatatgtgatgtgtatgtgtatatatttgtagaatgttttagtatttattttataggtatgtatagggttggttgtttttaataagttattattatattttgtatttatataggtttttttagttttggtatgatttttagaattattttgggaaatattttttttttaaagtttatagatgaggaaataagtaaaaagaatttaatgggtatttgtttgtatatattgtgagagagattgaggttagttaaagattttgtttattgttgaatttgggtgtgttggttgaatgtgtttatagatgggtttgtttagtgttttaggtgattttaggtttggtgggttttgg

SEQ ID NO: 44 - DNA, 3952 bp, Artificial Sequence
  chemically treated genomic DNA (Homo sapiens)
ggttgtagttggagaggaataggaattgtagtggggatgttttggtttttgggtttatagtatttgggatggatgtgtagtagtgtgggttgggaattgggtattagggtgggatgggtgagaggttttaagggataaggtagggagaagtgtagtggggtgtggggaattgtatgttttttttttgtttttgttttttattttgaggtggtagggtgggtgggtgtggttttgggggtgggtgggttgggtggggtggaggtggggttgtagtattggttttatttagttttttttgtttgtagttagagtgagttgagttgtggttagttttggtgggtagggggggtgttggagtgtagtgtagtgtagttttattagtttgtaaagtggattgagttggaagttgagtgttgttgtgggaggtgggtgatgggggtaggtgttattggttgtgttatggatgggttgtgtttgttgttgttgttgtttttgggggtgagtgttagttggagggggtttgtttttttttttgggattagaattttgagaagagttgggtgttgttattaaggaaatagaatagagtattggggttttagatattgagggtgggtggtgggaaaggatttttgatgttgggattatgaaggagggtttagggtttttggagtgtagaggtgattttttagggtggagatgagggtaagattggagtatggatgttggtttttaggtattgtagggggtggtgggggagttgggaggggttttttaagagggggtatggggttttttgatgtttaggttttttggaagaggatatttgaatgttgggattttgaagggattttttttttagtattttggtttttggagagttgtgggatagaattaaggtgagagaaggagggggaattggatggggattagagatgagaggggtgagttgggttggggtggggagtttgggatgatgggatggaataatggaggaggttggagggattggaggtagaggggatttggtaaggataatggggattggttagataatgggggggaggggtgttggagggagaggttggggagtgggagagaggttgagaagtgggttagggagggtagaagaggggtgatggtgagggtggtagagagatggaagtagaaggaaaggagatagagtggggtgtggattttgaagtggttggggttttgtttgtttgttgagggatagtgagatgagaagagagagtagaggtttggatatttttagtgtttgtttttgtgtttttgtttgtggttttttttagttttggaattggggttgtggatttaaggttgggaggggagtgtttattttgttggggtgaatttgtttttggggtttttttatggttggtgggtttttttgatgtgtgtgtttttatggtttgaagtagtgtagtggattgtgagggatggagtgggtgtgtttttatttgggttggtggtggttatgttttggggtgtagagtgttggggtgtattaggtggggattttttttggttgtgtgtagttttggttatgtaggtgggaggtggtaggtagggggtgttgtggggtgaggtaagtgtagtttgttgttgtttgtttgtgagtttggggttgtgtgttgttttttatttagttgtgtgatttgagtgttgtgtttattgtgttttgtgggtttttgtgttttgaagggttgggatttggtttgagttttttttggtttttggtgtaagttgttgggtatttaatgagatgggggtgtttggatgttttggattttgtagtgtggtattttgggttattgatttggtaaaggttggtgggttttttgggtggtttgatgagattgttagatgtggtttgttttatggttatgaattgaatgttttggaaggtttggtaatggaggaggtgtttttattttttttgttagtattttttattagagtattgtgttttaaattttggttttatagatatggagattgaggttttgagagtttaaatgatttggttaagattttatagtaagttgggttagagttgtggttagattttttgatttgatttttagtttggtatttttttatttttttagggggtagttgttgttttagtttggggttatggttgtgttttttagtagggtggggggggttgatattgtttttagagtttgttggtggtagagtttgtgggtgaggtgggtagagattttgtttgggtgtgggttttagtttgaaagtttagttttagttttttggagttgttaggatttgtggttgtgtttggggatttgggagtgattgtgggtatgtttgttgattaatgttgttggttagagatgttgtttagatgtgggtgggtgagtgtagattaggagagtggggaggagggattggattttagaggggtaatgatttgggttttgggtttgggtaagagtgagggtttttgtgtgaagatttaaggaaggaggggagttgggtgtggaggatttgggtgtttgggaaggtgtattttgataggaatttgttgtttgtagtttttgtggtttttgtttttgttttggtgtgtggttgtttggtttgggatggttgtgtgtggtttgagtttttttttgggttgtggtgagagagagagggttgaaattagagtgtgttttggtgggttggttggtgggttgtgttggtaatggaggtattttgttatttagatgtttgtaattagagttgttgggttggttaatgtgtttaatagggatggaatgagggtagtaaatgggtgtgtgtgagtggttgggttgagttgggtggatggtggatggggaggtagttttgtgggggatgggtttttattgtattgttttagtttagtttggtttaagtgttttgttttttttttgggggattgtgtggggaggtgggaataattgatgtgttgagtttttattaagtgttttgtatttttttggtagttttttttgaattatttaatttttataaggttttagtaaggtgaatttagttatttttattttgtagttgaggaaatagaattttttagatttttaggtttgagattaggtttttttagtgagttagtggtggtgtttttgttggaatttaggatgtttggtttgggatgtttttttttttatatatgttaggtttttttttgttttttattttttagattatggaaggagttgtggttttgagagattaaattgtgttttatgtttttggttttatatatttagatttgagttttttttttatatgtagaggttttgtttttttttaagtttttatgttatattattttgggtaattagtttttttttttttaattttttttttatttaaagggagtgaggggtatgtgttagtgttttttttgggtttgtattgattttaaaaggttttttaggtgtttgaaaattttttttattttatggtggtgattatggttttatttatttaagagttttttgttgaagttgttggaatggttagggttgattatattgaaatatttgtatggttttaaatatttttaattgttttgttgttttttttttttttttaattaaaaaaaatgaaaatttttaaaagttaatttatttaaggatttttttattttagttttttgtaagttttgaaatggttaaaataaaaagattataagtgtttttaaaaatgagatgaaattattttgttaaatgtgaaatgattaagtgtaatatatataaattttagggaaatttatttgttatttttataaattaatttttttggatttgattttggagtaattagtttgaatgttagttatttttttttatttggttaaattttttttttttgtttggggtttttttaagatgagatgtttttttgataattaatatttatt

SEQ ID NO: 45 - DNA, 3952 bp, Artificial Sequence
  chemically treated genomic DNA (Homo sapiens)
aataaatgttagttattaaagaagtattttattttaaggagattttaggtaggaggggagagtttagttaagtagggaggggtgattaatatttaggttaattgttttaaaattagatttaaaaggattaatttatagggatgatagataaatttttttgaaatttgtatgtgttatatttagttattttatatttgatagaatgattttattttatttttaagaatgtttgtaatttttttgttttggttattttaaggtttataaggaattaaggtggaaggatttttagatgaattgatttttaagaatttttattttttttaattagagaaaagagagaaatagtgaaatagttgaaagtatttgaaattatatgaatgttttagtataattagttttggttattttaatagttttagtaaagagtttttaagtgaatggggttgtggttattgttatgggatgggagagatttttaaatatttggagggttttttgaggttgatgtaaatttaggggaggtattggtatatattttttattttttttggataggggaggagttgggaggaaaggagttaattatttaagataatgtagtatagagatttgagagggggtagggtttttgtgtgtggagaaggggtttagatttaaatgtgtggggttaaaggtatagggtatgatttaattttttagagttatgattttttttatgatttagaaggtagggggtgggagggagtttggtatatgtaggaaagagaatattttaggttaagtattttgggttttaataaagatgttattattgatttattgggggagtttggttttgggtttgaaagtttagaaggttttgtttttttaattgtgaagtgggaataattaaatttattttgttaggattttataaggattaaataatttaagagaaattattagggaagtgtaaggtatttagtaggaatttagtatattgattatttttgtttttttatgtggttttttagggaagaagtgaggtgtttgagttagattgggttggaatagtgtggtaggggtttgttttttgtggagttgtttttttatttattatttatttagtttagtttggttgtttatgtatgtttatttgttgtttttgttttatttttattaggtgtattagttagtttggtggttttggttatagatgtttgaatgataaagtgtttttattattggtgtggtttgttagttgatttgttgggatgtgttttggttttagtttttttttttttattgtggtttaggaagaaatttggattgtgtatagttattttagattgagtagttgtgtgttgaggtggaggtgggagttgtaggggttgtagatggtaggtttttgttggggtatatttttttaagtgtttaggttttttatgtttagtttttttttttttttgggtttttgtgtggggatttttgtttttgtttagatttggagtttaagttgttgtttttttgggatttggttttttttttttgtttttttggtttatgtttgtttatttgtgtttgagtagtgtttttaattagtggtgttagttagtagatgtgtttgtggttgtttttaaatttttggatgtagttataggttttgatagttttagggaattggggttgagtttttgggttggggtttgtatttggatagaatttttgtttattttatttgtaggttttattgttgatggattttggggatagtgttaattttttttgttttgttgggaaatgtagttgtgattttgagttgggatagtggttgttttttgaaaaggtgggggagtattgagttgggaattaggttggggagtttagttatgattttggtttaatttgttgtgagattttggttaagttgtttaaatttttagagttttagtttttgtatttgtaaagttggaatttggggtgtagtgttttgatgaaagatgttggtggggagagtgaagatgttttttttgttgttagattttttagggtatttggtttatggttataaagtaggttatatttgataattttgttggattatttggaggatttgttgatttttgttgagttggtggtttgggatattgtgttatagaatttgaggtgtttgggtgtttttgttttgttaggtgtttagtggtttgtattgagagttaggagaggtttagattggattttgattttttgaggtgtgggagtttatggagtgtggtgggtgtggtgtttgggttgtgtagttaggtggggagtggtgtgtagttttagatttgtaggtaggtagtggtggattgtatttgttttgttttgtagtgttttttgtttgttgttttttgtttgtgtagttagagttgtgtgtggttaggaagggtttttgtttagtgtgttttggtgttttgtattttgagatgtagttattgttagtttgggtaggggtatatttgttttgttttttgtgatttgttgtgttgttttaagttgtgagaatatgtgtgttggaggagtttgttggttgtgggggaattttgggagtgggtttgttttggtgaagtgggtattttttttttagttttagatttgtagttttaattttgggattgggagaggttgtgagtaggagtgtggggataggtgttggaaatgtttaagtttttgttttttttttttgttttattgttttttagtgggtaggtgggattttgattattttagggtttgtgttttgttttgttttttttttttttgtttttatttttttgttgtttttgttgttgttttttttttgttttttttaatttattttttaattttttttttgttttttaatttttttttttgatgttttttttttttattgtttggttggtttttattgtttttgttgggttttttttgtttttagtttttttgattttttttattgttttattttgttgttttgggttttttgttttagtttagtttgttttttttatttttagtttttgtttagtttttttttttttttttgttttggttttgttttatgattttttagagattgagatgttgaggggaaagtttttttgggattttggtatttgagtgtttttttttgaagaatttgggtattggagagttttatgtttttttttgaaagattttttttagtttttttattgttttttgtggtatttgaggattggtatttgtgttttggttttgtttttatttttattttggagagttgtttttgtgttttgggaattttagatttttttttgtggttttggtattagaggtttttttttattatttatttttagtatttgggattttaatgttttgttttgtttttttggtggtggtgtttggttttttttggagttttgattttgggaaagggagtgggttttttttggttaatatttatttttagaagtagtaatagtagtaggtgtggtttgtttatggtgtggttggtggtatttgtttttattgtttgttttttgtggtagtgtttgatttttagtttggtttgttttgtggattgatggggttgtgttgtgttgtgttttagtgttttttttgtttgttggagttggttgtggtttggtttgttttggttgtgggtgggagaggttgggtgaagttagtgttgtggttttgtttttgttttgtttagtttgtttatttttggaattgtgtttgtttgttttgttgttttggggtgggaagtagaggtaaagggagggtgtgtggttttttgtattttgttgtgtttttttttgttttgttttttagagttttttatttattttgttttggtatttagtttttggtttgtgttattgtgtgtttgttttggatgttgtgggtttggggattagggtgtttttattgtggtttttgtttttttttggttgtggtt

SEQ ID NO: 46 - DNA, 2820 bp, Artificial Sequence
  chemically treated genomic DNA (Homo sapiens)
tttaggggataatatttaggtatgttaatggagtttaaaatgttaaggaaattatattataattttgtttagtatattataggttgttaaattgaaatgttatgttagttaggagtgtagtaatttttattttttggttttatttaattaggaagttttagtagagtgaagtttgttaagtgtttgttgttagaatttgaaggaatttgagtgagtaagaagagtgtttgatttattttatagaagtttgtttagaaatggaggagttagtgtttattgaagttggttttgtttttggtttgtttatatggagtttgattagttttagttatgtttattttggtttgggagatttgtaaagtgtttttttttttaatttttttgtattattttgaagtttagggaagtaaagagaggggtatatttggattgtaaaattaatgttttttgttgtttaggagagaagggaatgagagagagagagagatagatagatagagagagagagagagagagagagagagagagagagagagagagagaaattttattgaaatttagtttttttagaatttgtgtgatttggtttttaatgggagattagtgtgattttatggtatttttgttaggaattagtgatttttttgtagttattatttgatttattgtttttttgtttatttttttttataaagttattttttttttattttagtaagatttttttttttaatgatgataaagtttttgttttagtgttttttttaggattggtgtttttttaaaatagtgaatttagaaaattattttgtttaatattttttaaaatttttgtagttttaatgtaagtgtaagtatgtaaaggttttttgttatatttgtattttttgtttattttagaattattttttatttttgggtttgtaatagttttttttgtttttttggatagaggtgggtggtattaggggtttagggtagtaggaggtgaggggttgaggaggttgttagggtaggttggtttgtgttggatatgtgtgtttttttgtggagttaaagggttggggatgggggttttggatttattagagtaattttagttggtgggtgtttggtagttatttaaggaggtagggaaagtagtgagttttattgggtgggttatgatgagtagtatgatgggtagtagtagtagttagtaaaagtttttgtaaagtgtttagttgttgtattgttgtggggatttttatagtattatgattagtttgtgtaattttgtagtagtaaatggtttttgaggaatataggattgtgggggttgggtagtgggttattgagtattttgtggatggtggtagtagaggtggtggtggtggtagtggtatttggtggggaagtagtagttaaatttgtgtatgattttgagagttttagtaatatttagggattgggtttagttttggagtgagagggttgtttgttgagaagttgtgttggagatgtgggaagttgttgttataaggagggagttttgggaagttggaggataggaggagatgggagtttaggggtagatgagtggagtttgaggaggtagggtggagggagagttaaggtgttttgtagtttggtagttgttttttgagttttgttgtttgtatttttttggtgtttgggaagtagtaggtttttagtttgtttggggttatgtgggaagaggtagttgggttttgattggtggagtaggatgtaggttttgggagggaggggttgatgaggaggtgtaaggatgtaaggaggaggtggttgtggaagttatagatgggtttgtttgttaggtgttggtttgagtggggttaggtggggatggtttaaatgagaagtttgggttttagggtgggttatttgtatatttatatattatttgttttattttttgttttaggatgttttttattgaaggtggggtttggattagtgttttttttttgtgtgtgattttgggttgtgagtgtgggttgtggttgggtggtgtttttttgagttggagatggtgggggtggaggtgttagaggagtagtagtagtagggtagagaggggtgagttggtgtgggagagggtgttttgttggtgattggtgttttagtgtgtgggagtgtgttgtttaggttgtagggggatgtaggttgggaatgttgtggtggagaggttagggatgtttttttagggatttataggaaagagggtgagaggtgatggtgttagaattgtttttgttgatttggaagtaatagtagtattttttataagagtgtgtaattttaaggttgtttgttgaggtagtttagttattttggtaggtgttttttttttttttttttttttttttttttttttttaggttttttgtagttttgatttagtttaagtgtttgtaggtttgaatttttttttttattatttgtttttttttagtttgtagtttattagtgtgtttatttgggaggtgtggttagatgtgtttggaaggttagattggttgggataagtggtttgagagaaagagaaaggtttttttgtatatgttgtgggtgggttgttgggagtattggttgggtagtggtgtttgggaaggggagagtgggttttatttgttggtttaggtagtgattttgtgttttttatttgggtttttgttggatggttggtgatttggggtgatgagagaaggtttaatttggtaggagtttttggttttgtgtgttttttttattttttttagtgggaagggtaaatggtatagtgggatttgttttttg

SEQ ID NO: 47 - DNA, 2820 bp, Artificial Sequence
  chemically treated genomic DNA (Homo sapiens)
tggaaggtgggttttgttatgttgtttgttttttttgttggagagaatgaaagaaatgtgtagagttagagatttttgttgagttagatttttttttgttgttttaggttattggttatttggtaaagatttgagtaaggaatgtagggttattgtttgggttaataaatggagtttgtttttttttttttggatgttgttgtttggttgatgtttttggtaatttatttgtggtgtatgtagaggagttttttttttttttttagattatttgttttgattaatttgattttttaaatatatttgattgtattttttaggtggatatattaataggttatgggttggagaggagtgggtgatgaggagagggatttaaatttgtgaatgtttgggttgggttggagttgtggggggtttgggaggagagaggggagaagagagaaggaaggagagtgtttgttgggatggttgagttgttttggtgagtagttttggggttgtatgtttttgtgggagatgttgttgttgtttttaggttggtaagagtggttttaatattattgttttttatttttttttttgtaaatttttagagaaatgtttttggtttttttgttgtgatatttttagtttgtatttttttatagtttaggtggtgtgtttttgtatgttggagtgttggttgttagtaggatgtttttttttgtgttgatttgtttttttttgttttgttgttgttgtttttttgatatttttgtttttattatttttagtttggagagatgttatttagttgtggtttgtatttgtggtttggggttatgtgtggaagaggggtgttagtttggattttgtttttggtagggggtgttttggagtggagagtgaggtgaatggtatatgagtgtgtgggtagtttattttgaagtttgagttttttatttgagttatttttgtttagttttatttgggttagtgtttggtgagtgagtttatttgtggtttttgtggttgttttttttttgtatttttgtatttttttgttgattttttttttttgggatttgtattttgttttattaattagagtttgattgtttttttttatgtgattttgggtgggttgaggatttgttgttttttaaatgttagagggatgtgggtggtagagtttgagaggtggttgttgggttgtggggtgttttgattttttttttattttgtttttttgggttttatttgtttgtttttggatttttgtttttttttgttttttggttttttagagttttttttttatggtagtagttttttgtgtttttggtgtagttttttagtggatgatttttttgttttggggttgagtttagtttttggatgttgttgaaatttttgagattatgtgtgggtttggttgttgtttttttgttgggtgttattgttattgttgttgtttttgttgttgttgtttgtgggatgtttagtagtttgttgtttggtttttgtgattttgtgttttttggaagttgtttgttgttgtagagttgtatgaattagttatggtgttgtgggagtttttgtggtagtgtagtagttggatattttgtgagggtttttgttggttgttgttgttgtttgttatgttatttattgtagtttgtttggtgaagtttgttgttttttttatttttttaagtgattgttaaatgtttattggttggaattgttttggtaagtttagaatttttgtttttgattttttaattttgtagaagaatatgtgtatttagtatagattagtttattttagtggtttttttagttttttattttttattgttttagatttttaatattatttatttttatttagagaaataaggggaattgttgtaggtttgggggtgaggggtggttttgggatgggtagaaagtgtaggtgtagtaggaaatttttgtatgtttgtgtttatattggagttgtgaggattttgagaaatattaaatgggatggttttttgggtttattgttttgaaagagtattaattttaggggaaatattgaaatagaagttttgttattattaaagaaaaaagttttattaggatgaggaagaaataattttatgagaaagaatgagtgagaaagtaataaattaaatggtgattgtaggggaattgttgatttttggtaaaggtgttatgaggttgtattggttttttgttgaagattaggttatatagattttagaggagttgggttttaatagaatttttttttttttttttttttttttttttttttttttttttttttttttatttatttattttttttttttttttattttttttttttttaggtggtaaaagatattggttttgtagtttagatatgtttttttttttgtttttttaagttttaaggtagtataggggagttgagaaaaagaatattttgtgggttttttaggttggagtgggtatgattgaggttggttaggttttatgtaggtgagttgagggtggaattgattttagtgggtgttgatttttttatttttggataggtttttgtggagtgggttaggtattttttttgtttgtttgggtttttttagattttgatggtgaatgtttggtaggttttgttttgttgaagttttttaattaaatagggttagaggatgggagttgttgtatttttagttggtatagtattttggtttgatagtttgtagtatattgggtagaattgtggtgtaatttttttggtattttaaattttgttaatatgtttgggtattgttttttagg

SEQ ID NO: 48 - DNA, 3104 bp, Artificial Sequence
  chemically treated genomic DNA (Homo sapiens)
gtgggtgttgttgagtatggggaggtgttgaaatagttttggtgtgttgatttaagttttgattggtagagttatttggtgattgatagggggtttttatggtgtttgtgttgttaatttgtttattttaatagtggagttagtttgtttgttggtgtgtttgagttgagttgagtttgaattttaagttgtggagttagtattttttttagttggggttgtttgtttttggttgttgagttattgttgttatttggtagtgtgttttgttgttttaatttgttttattaataagtgtttggtatatttagttaggtttgtgggtatttgttgtgtgttttgttttgggtttagtgtttttgttgttgttggtattgttttgatgttttagttgtttattttgaattttagtttttagtaagtggttggggtatgtgagattttggaagagagtggtgatgtggagtgtttgggttgttttttttggttgttgtttgtggtttttgtggtttgtgaggtttttaataagaatgagttggtgttatgtgtatgagttattgtggttttttatggtggtaattattgtgagttttattatattttggaaaattataagtttattaaggagttgtatgttaagttgtaggtgttgtggtttgaagtatattattaggaggttgagaagttgtgtggaagatttttgggatttgtggataagtattgagtaaggaagaagtttttgttgttgtgtattatttgggatggtgaatagaagatatattgttttaaggagtgtatgtggtatttgttatgtgagtggtatttgtaggatttatattttaattttagtaaaaaatgtgagtttgtttaggtaattggattgatttttatgtaggtgggtaattggtttaaaaattgttgataaagggattgagtggttgtagttaagaataggttggtatttagaggtttttgtgttttgagtgtattggggaggaggtgggtggaggtatttttggtgtttttatttagtttttggtgattttaatttagtaggagttgggagtgtggtttgttttgggttaagagttttgtgttttgggtttttggttgggagtttttttgttggttttgtttttttatttgttggttttttatgtttgtgggtagttgtagtagttggttttggttattaaattaaggttttattgggatggagaggggaagagaaataaaaaattaaaattttataaatagttagggattttaagatttaaagttaatttttgttagtttgggtataggtttttattattaattgaagtttggtttattagtaatgtgttggttttatgttaattattatttttaaagtttaggtatatttttttttaatgttttgaaaatagtttttaatggatttttgagaaatgggaagttgagtttttttttttttatgtgttgtttgttatttttgttttaaaatagtaaattagtttgtgggttgaggttttttgttttttggagtgtggattttgattagttaaatattttgtggaagagtttggttttattttttaggtttaaatgttttttataattttttttgtttttaggttgggttgatttgatttaatgtgattgtgggagtatttgtttaggtgtaagttttaggtagatgtattgttagaaatggtattttatgtttttgggattgatttgtttttgttatttatattttgtttattttttgatagttttgtaaattttttaaaagtgtataataaatagggaggatattgtaagtttagtatataaaagatttgggagttgtggtgttgagaaagggtgtgaattatggtggggtataatagtagggatttgtggaggggtggttgtggatttttgtttgatttttgttgttttgttgagtaatttttgttttaattgttggggtttttggaagaatttttagttgttgggttggagggatgtaggaggtggtgggggtgggtgatgggtggttgtgttatgagttgtgatttgtgtttttttttttttttgtagattttagtagtaggttttgttatagggttttgggtgggtattatgggtggagggtgatggtatgttagaggtgttgggtgttgttattagtttggttgttagtttatttagtaaggtggttattttagttatttttattatgtttagtgatagtgagtgtgatatttgagttgtttatttaggatgtttagaagtagattttagtgtaaaaatgagaaaaataaaatgaaagaggggaagaagatgagagatttgtaaatttagtgttatagaagttaggtgattagggatttgtgggtttgggttgttgttttttgttttattttgtggttggtttggttttattggtgttttttggttgtgattatgggaattagtgtgaggtttgatttagtattatgttttttttgttttgtttttttttaaggattttgttgtaaagtttttttggaatttgaattgtaagttgagtgtttgtttagatttttttatgggtattttatgttgaaaggatgttgttatatatgtataatttttgttttaaagtttttttttaataaaatatatatatgttgtttatttatttatttaagagattgttatggtaggtttttttgtagtttggggaatttgttgtttttaaatatgtaggttggtggtgatgggttttgtgtggagaagttaaataataaaataatttagtgggtaatttttttaattaagggagttgtttttagattttttttttttttattattattaatattattttttttattaggtatgtagggatttttgagtaaatggtttttggaaggttttatttatatattttttgttttttttggtgttttttggtatatgttttaaataatttatggtaggtttataattattttttatgttaaattatatgtatgtgtatatatgtatgtatttatataaatatatgtatgtatttatataaatatatgtatgtatgtatatatgtgatatatttaaggttagaaattggtaatatgtgagtgtttttttta

SEQ ID NO: 49 - DNA, 3104 bp, Artificial Sequence
  chemically treated genomic DNA (Homo sapiens)
tagagaggatgtttatatgttgttaatttttagttttaaatatattatgtgtatgtatatatatatatgtttgtataggtatatatatatgtttgtataggtatatatatatatgtatatatgtgtaatttgatgtgggaggtggttatagatttattataggttgtttaaaatatatattaggaagtattaaagaaggtaaaagatatataggtaagattttttggagattatttgtttaagggtttttgtatgtttggtgaagggaatgatattaataataataagaagaaaaggaatttgagagtagtttttttaattaagaaggttgtttattaggttgttttattgtttggtttttttatatagaatttattattattagtttgtatgtttagaaatagtaagttttttaagttatagagaaatttattatggtggttttttaaataagtaaataaatagtatatatatgttttgttaaaaaaaaattttaaagtgaaagttatatatatgtaatagtgtttttttgatgtgaaatatttatgggagaatttgggtaggtgtttagtttgtagtttgggttttgaagagattttgtagtaaaatttttaggaaaaagtaaagtaagaagaatgtggtgttgggttaggttttatgttggtttttgtggttgtggttaaagggtgttagtgaagttaggttggttgtggggtggggtgggaaatggtaatttgagtttgtgggtttttggttatttggtttttgtggtgttggatttgtaggttttttatttttttttttttttttattttgttttttttgtttttatattggaatttgtttttgagtattttggatgggtaatttagatgttgtatttgttgttgttggatgtgatggagatggttgaagtggttgttttgttggatagattggtggttgggttggtggtgatgtttagtatttttggtgtgttgttgttttttgtttgtagtgtttgtttggaattttgtgataggatttgttgttggagtttatggggaagaaagggaatatgggttatagtttgtaatatagttgtttgttgtttgtttttattattttttgtgtttttttagtttggtggttagaggtttttttgaagattttagtagttaaggtgaggattatttggtaaggtgatagaggttgggtaggagtttgtggttgtttttttgtgggtttttattgttgtgttttattatgatttgtgtttttttttagtgttgtagtttttaggttttttatatattgggtttgtagtgttttttttgtttgttgtgtatttttgggagatttataggattgttaggaaataaatgaagtgtgggtgataaggatagattggttttagggatatgggatattatttttaatggtgtgtttgtttggggtttatgtttgagtaagtgtttttgtgattgtgttggattgggttggtttgatttaaaggtaaaaaggattgtaaggagtatttgggtttgggggatgaggttgggtttttttgtaaaatgtttggttaattgagatttatattttgggaaatgaaaagttttggtttatggattagtttgttgttttgagataagagtggtaggtagtgtatgggaagaggaaaatttgattttttattttttaaaagtttattgaaaattgtttttaaagtattagggagggatatatttgggttttgaaaatgataattaatatgaaattgatatattgttaataagttaggttttgattaatagtaggagtttgtgtttaggttgataagaattagttttgggttttggggtttttaattgtttgtaggattttaattttttatttttttttttttttttgttttagtgaagttttggtttggtgattgggattagttgttgtagttgtttgtaggtgtggggagttagtgggtggggaagtagagttggtaagggaatttttggttaggagtttagaatgtagggtttttaatttaagatagattgtgtttttaatttttgttgaattggagttgttagggattgggtaagggtgttagaggtgtttttatttgttttttttttggtgtgtttaaagtgtggaggtttttaggtattgatttgtttttggttgtagttgtttggtttttttgttggtggtttttgaattagttgtttatttgtgtaggggttagtttggttgtttgggtgagtttatgttttttgttggggttagggtatggattttgtaggtattatttgtgtagtaggtgttgtgtgtgttttttgaagtagtgtgttttttgtttgttgttttaaatggtgtgtggtagtgggaattttttttttatttggtatttgtttataggttttaggggttttttatgtagttttttagttttttggtagtgtgttttaagttatagtgtttgtagtttggtgtgtgattttttggtgaatttgtggttttttaggatatgatagagtttgtggtagttgttattgtgaaaggttatgatggtttgtgtgtgtagtattgatttatttttgttgagggttttgtaggttgtaggggttatgggtagtgattagaggaagtgatttaggtgttttatattgttgtttttttttagggttttatatattttggttatttgttgggggttgaaatttaagatgggtagttggaatattgaggtagtgttggtggtggtgagggtattgagtttggagtgggatatgtagtagatgtttgtgggtttggttgagtgtgttaggtgtttgttgatgaggtggattggggtagtgggatatattattgggtggtggtggtggtttaatggttgggagtggatgattttgattggaggaggtgttggttttgtggtttggggtttgggtttggtttggtttaggtatgttggtaggtgagttggttttgttattggggtgggtggattggtggtgtgggtgttatggagattttttgttagttattgggtggttttgttaattaaagtttgaattagtatgttaggattattttagtatttttttgtgtttgatagtgtttgt

SEQ ID NO: 50 - DNA, 2378 bp, Artificial Sequence
  chemically treated genomic DNA (Homo sapiens)
attttgagattttagttgattttttttgttttgtaattagaggggattgtgatttgggttaattttttttttatgggttttagtggagttagttgtggaatggaatattaatttttattttataggtatgttgtgaggttttgttaagaaatagttataaaagggttttaagagttatgatgattgttttaattatttagtagggagggggtatttagtggtgttgtttttatgtattgatgttatgtggggtggggaggtggggtggagaatggagagtgtttttttattttttattttttttttttaagtttagtgtagggggaggtggttgtgattgattgaggggttagggaaggttggttaggggtgtgggtgtggttggggatggtttgggggtggggttgtgtaggaggttggaggagttttgtgggatttagaggtggggtgttggtttggggattattgtttttttggggtgtggttgtaggaggttggaggagttttgtgggatttagaggtggggtgttggttggggattgttgtttttttggggtgtggttgttgttgagtattttttagtttagttgagtttgtgtttaggttatgttttgttttagttgttgttttttttattttatggtgtttggagttattttttgtttgtttgttttttttttttgtttattttttgtatttgggtttgtattatttttgttaattgtttttttgattttgttgatattttttttttaaatttttgattggtatttttgtttggtatttttttttttatttttttttttttattttttttttttgattttttttgggtttttttttttttaaaatttgggtttttttgtgtggttttgtttttaggttggggatgttttttgtggttttgtgtttatggttttgatgttgtttttttttgtttataagttgtgttgtttttttgttatgttgggtttatggtggggtgttgagtggttggtggtgtttgggttagatgggggtggtggtatgggtttatggtgggttgtgggtggtttgggtttgtgaaagtgttgttgggggtaggtattgaggtgtaggatgttttggagtgtgtgttgttggagttgtagtaggttttgtttgtgttgaagtaggtgggtggtgtgtgggttgtgggtgttggtttggttgaggttttttaattggtggaggaggtttggttgttgtggttgtgggttgtgaggtagtttagggtttgtgtgatgttatttgttttgatggtggttttgatttgttgttgtggttgttgtaggtgttggagttggagatgtgtgtgtaggttgtgtgtttgttggagtagattttggtggttgagaattggtgagtgtgttaggttggggttgggagagtgttgtgtggtgtggatagttaagtgtttgtgtttttgtgtgttttgtgttgtgtttttgttttttttatttttttgattgtttgtattatatttttgttaggggttagtttgtttgttttatagataaggaaattgagttttgggaaagtttagtgatttgtttagtggattatagtgaattaagatttgtttttagggttagtggggtgaggaatggagttataggataggagtttgtttttggttttatggatggagatggtattttattgttaatttttttttttttttgttttttaagtttatagtttttttttttattggtttgggtttttgtttatgatatttttttttgttattattttattttttttttaatgagagaagaagggaaatataatgtttagaaaagagggagggagatttttttttttttttttttttaggttgtaaggtgtgttggtttgaggttgtttattttttttttgttgttttaatttaatttttgttttattttttattttggtttttgtaataggttagatatgattttattttgtagttgttgatgggaaatagttttttgttgggaggtatgggtgggggaagaggatattggggtgtagagtttggtggggattaggtagagtgtgtgttttttttttttattttatttagtattaagatgttgtaagagggttaaatagaggtttggttgttatttttgtatgttttttgggattttttttggagtatgaagatttttaaggatttatttttttttttttttgatgttagagtagattaagttgttatattttagttttatgttgaagtttttagttttttaagtttagaagagtttttggaagagttatttttagtttatgtagtttttataagtgtgaagggagtgggttgggggtgttttttttgttatttttgaaaagaaaaaaattatttggtg

SEQ ID NO: 51 - DNA, 2378 bp, Artificial Sequence
  chemically treated genomic DNA (Homo sapiens)
tattaggtaatttttttttttttgaaaatggtaaggaaaatatttttaatttattttttttatatttgtgagagttgtatgagttgaaagtgatttttttaaaaatttttttaagtttgagaagttggagattttagtatgagattggagtgtgatagtttggtttgttttggtattagaagggagggaaagtgagtttttggaggtttttatattttaggagagattttaagagatatgtaagagtggtaattaggtttttgtttgatttttttgtggtattttggtgttaagtggggtgaagggagagaatatatattttgtttggtttttgttgggttttgtattttggtgttttttttttttatttatgttttttagtagaaaattgttttttattagtagttgtagaatgagattatgtttggtttgttgtaagaattagaatgaaggatggagtagaagttggattggggtggtaagaagggagtaagtagttttaggttagtatgttttatagtttggggaggagggaaaggagaggttttttttttttttttttgagtgttgtgttttttttttttttttattgggagagggatgggatgatggtgagagaaggtgttatagatgggaatttaagttggtgggaaggagagttgtgggtttggggggtgggggagagggagaattggtaataggatgttatttttatttatagagttagggatggatttttgttttgtaattttattttttattttattagttttgggagtaaattttagtttattgtgatttattgagtaagttattaaatttttttaaggtttagtttttttatttgtgaaatagataggttgatttttaatagagatgtagtgtaggtagttagagaggtgagggaggtaaaggtatggtgtaaggtatatgggaatgtaggtgtttaattgtttatattatgtggtgtttttttaattttggtttggtgtgtttattggtttttagttattaggatttgttttagtaggtgtgtggtttgtatatgtgtttttaattttggtgtttgtagtagttgtaatagtaggttgaggttgttattgaggtggatggtgttgtatagattttgggttattttgtggtttatggttgtagtagttaggttttttttattagttggaagattttggttaggttggtgtttatggtttgtgtgttgtttgtttgttttagtgtggataaggtttgttgtagttttggtagtgtgtgttttagggtgttttgtattttggtgtttgtttttggtgatatttttgtgggtttgggttatttgtagtttattatgggtttgtgttattgtttttatttggtttaggtattgttagttgtttggtgttttgttgtgggtttgatatggtgaagaagtgatatagtttgtaggtggagagaagtagtgttaggattatgggtgtggggttgtgggggatatttttggtttggaggtggggttatgtggagagatttgggttttgggaaaagagggatttgagaggggttggggaaagaagatggagggggaggaatggagagaagggtattaggtaagggtgttggttagaagtttgggggaggagtgttggtaggattgggggagtggttggtaaaggtgatgtaggtttagatgtagggagtgggtgaaaggagagagtgagtaggtgagggatggttttggatgttgtagggtagaggaggtggtggttggaataaagtgtggtttgggtatgggtttggttgagttgggagatgtttggtagtagttatgttttggaggagtagtggtttttggttgatgttttgtttttgggttttgtggggtttttttagttttttgtagttatgttttggaggagtagtggtttttgggttgatgttttgtttttgggttttgtggggtttttttagttttttgtgtagttttatttttaagttgtttttagttatgtttatgtttttggttagttttttttagttttttagttagttgtagttatttttttttgtgttggatttggaggaagggggtggagaatgagaggatgttttttgttttttgttttgtttttttgttttatgtgatattggtatgtgggagtaatattgttggatgttttttttttattaaatggttaaaataattattataatttttaaggtttttttatggttgttttttagtgaaattttataatatgtttatggggtgggaattgatgttttattttatagttgattttattgaagtttatgaggaagaaattggtttaaattatagttttttttgattatagaatagaaaaagttagttaaaattttaggat

SEQ ID NO: 52 - DNA, 2436 bp, Artificial Sequence
  chemically treated genomic DNA (Homo sapiens)
agttttggatgataaggattaattgtttagggtgttggttgagaggaataggaagagtgttttgtggagtagggtgggtgagaagagttgggtggttgtggggtttttgtgtatgttgggtaggaagaggaagagttgtagtatgaaggttattagggagatgtataagaagtaggtgggggttattatgttgagtagttgtagggttagtatttttgattatatttttgtggggtttggggtgagaagaggattgattgattatggtgtttagggggtgtttttgtttgtttttttgtgttgtgtgtttggggtattgtatgtgattttatgtttttaattttttgttttgtggattttttttttttagttttttaattttggattaggtaggttagagatttgagtttgtagtggttttgggtttaggttttatttgggggtgagtgttgtttggggttttgagtgagtttggtgttttggtgtggtagagtttggtataggagggagggatttgtttgtagtttttaggagttgtgagggtggggggtattgggggataggattttttttttttgtggatgtggaaataagtttaggtttgggatttttggtttagatttttttaggaggagaaagggaaggatttggggttgggggtaggagaattagtggtatttgatttgttggaaattttgttttatatttttttttttttgtttttgtgtttttatttatatatatattttgggtagtatttagggattttattaggttatttaaggttttttggaggtatgtgtgtgtgagggattatgatgtgtgtgtgtgtgtttttgtttgtgattttgtatgtgtaatttgtgtgtgtttgagtatttgtatttgtgtatgtatatatttgtgtgtatagatatgtagtttttgttatttagttttaaaaaaattaattgaaataattgatatatttatatttgtttttgggtattgggtgaggtgggggtgtaattagaatatttgtgttagtgggttttggttagtatatttttttaatgttggttgtttgggttatttttttgtgaagagtgtttttatttgaggtgaaattaaaattttttttttgtgtttgttttttgtttttttgttgagagaaatttaaataatttttatggtgttgaaattttttttatgttgataagtttgttttgggtgtatgagtggatgtttggttagttttttttgggattgattttgttgttgtgtttagtttttattatgtttttattttattttatgttttatagttggggtttttggttagttttggaagttattgagaaataggattttgtgtgtttgagagaatttttttaggggttaaggaattggttagttggaggtgtgagaaaagttttgggaaggtggttgtatttaggatgggtggatgttatggggtttttgtttaggttgttttgtttgtatgggttgattggttattttggaattttttttgtaggttttagtgttttttgggaatttgtagtttttgtggagagtgtgggtttttttttattgttggggtgtagtgtagtgtatgtttgagggtggttgttgggggttgggtatgtttttagttttgtgttgttgggggttgtggtggtgttgtttattttagagagtttttggtttggggttttggtgaagtaagtgtttttttggtgttggttgttaggggggtgtgggagtagttagatgtgttgtagtgttgggaaggtggtgaaggataggggttaggggagtgaggggtgtttggtaggtagttttagttttggttttgtgtgggagaagggatagtagagattgtttgtggggttttggggtgtagggagttgtttgtttagttttggtgtttgttttgtttgtggtagagggtggtatagttggagttttggaaagattggtagtgttggtagttgtgggttttttggttattgttttttggatgtatgggaagttgttttttgtgttgttgttgttgtattgttgttgttgtagaggggtgaggaaattaatttattgagttttggttgttgataagaggagttttggatgttggtttttgttttgtttgaggttgtaaagttgtggatttggtttggttggtttgtagtttgtgttttgttttgggaattgggtaagtagtggggatgtggggaggagggagtgggtagttgttggttttttatttgggtgttagtgagtaagggttaggaagtggtggggatggtagttgggtattttttagttttgttatttttttttttgtttttgggggtggtgttttggttgttagttttagtattgtggatttgtttttttttttttttttgattttttttgagtgggttggggtgttttgtttggttttagtgtttg

SEQ ID NO: 53 - DNA, 2436 bp, Artificial Sequence
  chemically treated genomic DNA (Homo sapiens)
tgggtgttgaaattaggtagggtgttttagtttgtttaaggggaattgagaggggaggagggggtaagtttatgatgttgagattggtggttagagtattgtttttaggagtggagggaggggtggtggggttggggggtgtttagttgttatttttgttgttttttggtttttatttgttggtgtttaagtgggaagttagtagttgtttgtttttttttttttatatttttgttatttgtttagtttttgaagtgaagtgtaggttgtgagttagttgggttgagtttataattttgtagttttgggtagggtgagagttggtgtttggggttttttttgttggtgattagagtttggtgagttgatttttttatttttttgtgatggtggtagtgtggtggtggtggtgtggggggtggttttttgtgtgtttgggaggtagtggttgagaagtttgtggttgttggtgttgttggtttttttaaggttttggttgtgttgttttttgttgtgggtgaggtgggtgttagggttgaatggatagttttttatattttggggttttatgggtggtttttgttgtttttttttttgtgtagggttagggttgaggttgtttgttgagtgttttttatttttttagtttttgttttttgttgtttttttagtgttgtggtgtatttggttgtttttgtgtttttttggtgattggtgttgggaaggtatttgttttgttggagttttaggttgagggttttttggggtgggtagtattgttgtagtttttggtggtgtaggattgggggtgtgtttagtttttggtgattatttttaggtgtgtattgtgttgtgttttagtggtagggagaggtttatgttttttgtggaggttgtgggtttttggggggtgttgggatttgtaaaggggattttaaggtgattagttgatttgtgtggatgggatagtttggatggaggttttgtggtatttatttattttaggtgtaattgtttttttagaattttttttgtgtttttggttggttgattttttagtttttggaaaagtttttttgggtgtatggaattttattttttggtggtttttgaagttggttaggaattttggttgtgaggtgtggggtgggatggggatgtggtgagggttgagtatggtggtggggttgattttaggaaaggttggttaagtatttatttgtgtgtttagggtgggtttgttggtatggaaaggattttggtgttatgagggttgtttgggttttttttagtaggagggtgggaggtgggtgtgaaggggggattttaattttgttttaaatgaaaatgttttttgtaaagaaatagtttgggtagttagtgttggagagatgtgttggttaggatttgttgatataggtattttggttgtgtttttattttatttggtgtttgagagtgagtgtgagtgtattgattgttttaattgatttttttaaagttagatagtagaggttgtgtgtttgtatatgtagatatatatatatataaatatagatatttaagtgtatatagattatatgtatagagttatagataaggatatatatatatatattgtggttttttatgtatatatatttttaaagagttttgggtaatttggtgaggtttttgagtgttgtttaagatgtgtgtgtgggtggggatgtagggatggagaaaggggagtgtgaagtaggatttttagtaggttaagtgttgttgatttttttgtttttgattttaaatttttttttttttttttttagggaggtttgaattagaaattttaaatttgggtttgtttttatatttatagaggggaggagttttattttttggtgttttttatttttataatttttaaagattgtaaatgagttttttttttttgtgttagattttgttgtgttaaggtgttgagtttgtttaaaattttaggtaatatttatttttaggtggggtttagatttgaggttgttgtgggtttgggtttttggtttgtttgatttggggttagggaattggggaggggaaatttgtgggatagggggttgggggtgtggagttgtgtgtagtgttttagatgtgtggtatggaggagtgggtgagggtgttttttggatgttgtagttagttagttttttttttattttgggttttgtaggaatgtaattgaggatgttggttttgtggttgtttaatgtggtggtttttgtttattttttgtgtatttttttggtgatttttgtgttgtagttttttttttttttgtttagtatgtgtgaggattttgtggttgtttggttttttttgtttgttttgttttatggggtgttttttttattttttttggttaatgttttgggtaattagtttttgttatttagaatt

SEQ ID NO: 54 - DNA, 32 bp, Artificial Sequence
  chemically treated genomic DNA (Homo sapiens)
catcatatcaaaccccacaatcaacacacaac

SEQ ID NO: 55 - DNA, 25 bp, Artificial Sequence
  chemically treated genomic DNA (Homo sapiens)
gttcgaaatgattttatttagttgc

SEQ ID NO: 56 - DNA, 17 bp, Artificial Sequence
  chemically treated genomic DNA (Homo sapiens)
cgttgatcgcggggttc

SEQ ID NO: 57 - DNA, 17 bp, Artificial Sequence
  chemically treated genomic DNA (Homo sapiens)
ggggagggttgtttatt

SEQ ID NO: 58 - DNA, 17 bp, Artificial Sequence
  chemically treated genomic DNA (Homo sapiens)
cccctccctttaactct

SEQ ID NO: 59 - DNA, 31 bp, Artificial Sequence
  chemically treated genomic DNA (Homo sapiens)
ttaactctccccaacaactctcaaaccccac

SEQ ID NO: 60 - DNA, 24 bp, Artificial Sequence
  chemically treated genomic DNA (Homo sapiens)
ttagtcggaggtgaggaacgattt

SEQ ID NO: 61 - DNA, 24 bp, Artificial Sequence
  chemically treated genomic DNA (Homo sapiens)
ttatttcgttgtcgggtttaagcg

SEQ ID NO: 62 - DNA, 20 bp, Artificial Sequence
  chemically treated genomic DNA (Homo sapiens)
ggagtggaggaaattgagat

SEQ ID NO: 63 - DNA, 22 bp, Artificial Sequence
  chemically treated genomic DNA (Homo sapiens)
ccacacaacaaatactcaaaac

SEQ ID NO: 64 - DNA, 33 bp, Artificial Sequence
  chemically treated genomic DNA (Homo sapiens)
tgggtgtttgtaatttttgttttgtgttaggtt

SEQ ID NO: 65 - DNA, 22 bp, Artificial Sequence
  chemically treated genomic DNA (Homo sapiens)
gtagtagtagtagggtagagag

SEQ ID NO: 66 - DNA, 19 bp, Artificial Sequence
  chemically treated genomic DNA (Homo sapiens)
catccccctacaacctaaa

SEQ ID NO: 67 - DNA, 35 bp, Artificial Sequence
  chemically treated genomic DNA (Homo sapiens)
caacctaaacaacacactcccacacactaaaacac

SEQ ID NO: 68 - DNA, 16 bp, Artificial Sequence
  chemically treated genomic DNA (Homo sapiens)
cgcgggagagggcgtt

SEQ ID NO: 69 - DNA, 19 bp, Artificial Sequence
  chemically treated genomic DNA (Homo sapiens)
tgttggcgatcggcgtttt

SEQ ID NO: 70 - DNA, 16 bp, Artificial Sequence
  chemically treated genomic DNA (Homo sapiens)
gggtttcgggcgggta

SEQ ID NO: 71 - DNA, 21 bp, Artificial Sequence
  chemically treated genomic DNA (Homo sapiens)
atatcgcactcgctatcgcta

SEQ ID NO: 72 - DNA, 23 bp, Artificial Sequence
  chemically treated genomic DNA (Homo sapiens)
gagggcgacggtacgttagaggt

SEQ ID NO: 73 - DNA, 24 bp, Artificial Sequence
  chemically treated genomic DNA (Homo sapiens)
ttgggcgtcgttattagttcggtc

SEQ ID NO: 74 - DNA, 19 bp, Artificial Sequence
  chemically treated genomic DNA (Homo sapiens)
gtcgggttggagggacgta

SEQ ID NO: 75 - DNA, 21 bp, Artificial Sequence
  chemically treated genomic DNA (Homo sapiens)
atatcgcactcgctatcgcta

SEQ ID NO: 76 - DNA, 23 bp, Artificial Sequence
  chemically treated genomic DNA (Homo sapiens)
gagggcgacggtacgttagaggt

SEQ ID NO: 77 - DNA, 24 bp, Artificial Sequence
  chemically treated genomic DNA (Homo sapiens)
ttgggcgtcgttattagttcggtc

SEQ ID NO: 78 - DNA, 21 bp, Artificial Sequence
  chemically treated genomic DNA (Homo sapiens)
gaggtgttagaggagtagtag

SEQ ID NO: 79 - DNA, 17 bp, Artificial Sequence
  chemically treated genomic DNA (Homo sapiens)
tccccctacaacctaaa

SEQ ID NO: 80 - DNA, 37 bp, Artificial Sequence
  chemically treated genomic DNA (Homo sapiens)
acctaaacaacacactcccacacactaaaacaccaat

SEQ ID NO: 81 - DNA, 15 bp, Artificial Sequence
  chemically treated genomic DNA (Homo sapiens)
cgagtcggcgcggga

SEQ ID NO: 82 - DNA, 20 bp, Artificial Sequence
  chemically treated genomic DNA (Homo sapiens)
agggcgttttgttggcgatc

SEQ ID NO: 83 - DNA, 25 bp, Artificial Sequence
  chemically treated genomic DNA (Homo sapiens)
aaaaaaaaaaaactcctctacatac

SEQ ID NO: 84 - DNA, 24 bp, Artificial Sequence
  chemically treated genomic DNA (Homo sapiens)
ggttattgtttgggttaataaatg

SEQ ID NO: 85 - DNA, 38 bp, Artificial Sequence
  chemically treated genomic DNA (Homo sapiens)
acatacaccacaaataaattaccaaaaacatcaaccaa

SEQ ID NO: 86 - DNA, 21 bp, Artificial Sequence
  chemically treated genomic DNA (Homo sapiens)
ttttttttttcggacgtcgtt

SEQ ID NO: 87 - DNA, 20 bp, Artificial Sequence
  chemically treated genomic DNA (Homo sapiens)
tcggtcgatgttttcggtaa

SEQ ID NO: 88 - DNA, 20 bp, Artificial Sequence
  chemically treated genomic DNA (Homo sapiens)
tgagagagagagggttgaaa

SEQ ID NO: 89 - DNA, 24 bp, Artificial Sequence
  chemically treated genomic DNA (Homo sapiens)
tctaaataacaaaatacctccatt

SEQ ID NO: 90 - DNA, 27 bp, Artificial Sequence
  chemically treated genomic DNA (Homo sapiens)
ccattaccaacacaacccaccaaccaa

SEQ ID NO: 91 - DNA, 16 bp, Artificial Sequence
  chemically treated genomic DNA (Homo sapiens)
cgacccgccaaccgac

SEQ ID NO: 92 - DNA, 15 bp, Artificial Sequence
  chemically treated genomic DNA (Homo sapiens)
cgccgaaacgcgctc

SEQ ID NO: 93 - DNA, 26 bp, Artificial Sequence
  chemically treated genomic DNA (Homo sapiens)
gtagtagttagtttagtatttatttt

SEQ ID NO: 94 - DNA, 17 bp, Artificial Sequence
  chemically treated genomic DNA (Homo sapiens)
cccaccaaccatcatat

SEQ ID NO: 95 - DNA, 32 bp, Artificial Sequence; identical to SEQ ID NO: 54
  chemically treated genomic DNA (Homo sapiens)

SEQ ID NO: 96 - DNA, 19 bp, Artificial Sequence
  chemically treated genomic DNA (Homo sapiens)
gaaccccgcgatcaacgcg

SEQ ID NO: 97 - DNA, 26 bp, Artificial Sequence
  chemically treated genomic DNA (Homo sapiens)
gtagtagttagtttagtatttatttt

SEQ ID NO: 98 - DNA, 17 bp, Artificial Sequence
  chemically treated genomic DNA (Homo sapiens)
cccaccaaccatcatat

SEQ ID NO: 99 - DNA, 32 bp, Artificial Sequence; identical to SEQ ID NO: 54
  chemically treated genomic DNA (Homo sapiens)

SEQ ID NO: 100 - DNA, 25 bp, Artificial Sequence
  chemically treated genomic DNA (Homo sapiens)
gttcgaaatgattttatttagttgc

SEQ ID NO: 101 - DNA, 17 bp, Artificial Sequence
  chemically treated genomic DNA (Homo sapiens)
cgttgatcgcggggttc

SEQ ID NO: 102 - DNA, 20 bp, Artificial Sequence
  chemically treated genomic DNA (Homo sapiens)
ccaaaacctaaacttacaac

SEQ ID NO: 103 - DNA, 17 bp, Artificial Sequence
  chemically treated genomic DNA (Homo sapiens)
ggaaatttgaggggtaa

SEQ ID NO: 104 - DNA, 31 bp, Artificial Sequence
  chemically treated genomic DNA (Homo sapiens)
tacaacaccaccaacaaacccaaaaacacaa

SEQ ID NO: 105 - DNA, 19 bp, Artificial Sequence
  chemically treated genomic DNA (Homo sapiens)
gttaattgcgggcgatcga

SEQ ID NO: 106 - DNA, 17 bp, Artificial Sequence
  chemically treated genomic DNA (Homo sapiens)
cgtcgttagcgggtggg

SEQ ID NO: 107 - DNA, 20 bp, Artificial Sequence
  chemically treated genomic DNA (Homo sapiens)
aaaatcctctccaacacgtc

SEQ ID NO: 108 - DNA, 20 bp, Artificial Sequence
  chemically treated genomic DNA (Homo sapiens)
cgcgattcgttgtttattag

SEQ ID NO: 109 - DNA, 25 bp, Artificial Sequence
  chemically treated genomic DNA (Homo sapiens)
cggatttcgcggttaacgcgtagtt

SEQ ID NO: 110 - DNA, 24 bp, Artificial Sequence
  chemically treated genomic DNA (Homo sapiens)
tctaaataacaaaatacctccatt

SEQ ID NO: 111 - DNA, 25 bp, Artificial Sequence
  chemically treated genomic DNA (Homo sapiens)
gttttttttattagttggaagattt

SEQ ID NO: 112 - DNA, 20 bp, Artificial Sequence
  chemically treated genomic DNA (Homo sapiens)
aaactacaacaaaccttatc

SEQ ID NO: 113 - DNA, 37 bp, Artificial Sequence
  chemically treated genomic DNA (Homo sapiens)
ccttatccacactaaaacaaacaaacaacacacaaac

SEQ ID NO: 114 - DNA, 17 bp, Artificial Sequence
  chemically treated genomic DNA (Homo sapiens)
cgtttacggttcgcgcg

SEQ ID NO: 115 - DNA, 20 bp, Artificial Sequence
  chemically treated genomic DNA (Homo sapiens)
cgttcgtttgttttagcgcg

SEQ ID NO: 116 - DNA, 23 bp, Artificial Sequence
  chemically treated genomic DNA (Homo sapiens)
ggtgttgtttattttagagagtt

SEQ ID NO: 117 - DNA, 17 bp, Artificial Sequence
  chemically treated genomic DNA (Homo sapiens)
ctcccctaacccctatc

SEQ ID NO: 118 - DNA, 29 bp, Artificial Sequence
  chemically treated genomic DNA (Homo sapiens)
ctatccttcaccaccttcccaacactaca

SEQ ID NO: 119 - DNA, 16 bp, Artificial Sequence
  chemically treated genomic DNA (Homo sapiens)
ttaggggggcgcggga

SEQ ID NO: 120 - DNA, 21 bp, Artificial Sequence
  chemically treated genomic DNA (Homo sapiens)
gttagatgcgtcgtagcgttg

SEQ ID NO: 121 - DNA, 20 bp, Artificial Sequence
  chemically treated genomic DNA (Homo sapiens)
aaaatcctctccaacacgtc

SEQ ID NO: 122 - DNA, 20 bp, Artificial Sequence
  chemically treated genomic DNA (Homo sapiens)
cgcgattcgttgtttattag

SEQ ID NO: 123 - DNA, 25 bp, Artificial Sequence
  chemically treated genomic DNA (Homo sapiens)
cggatttcgcggttaacgcgtagtt

SEQ ID NO: 124 - DNA, 20 bp, Artificial Sequence
  chemically treated genomic DNA (Homo sapiens)
aaaatcctctccaacacgtc

SEQ ID NO: 125 - DNA, 20 bp, Artificial Sequence
  chemically treated genomic DNA (Homo sapiens)
cgcgattcgttgtttattag

SEQ ID NO: 126 - DNA, 25 bp, Artificial Sequence
  chemically treated genomic DNA (Homo sapiens)
cggatttcgcggttaacgcgtagtt

SEQ ID NO: 127 - DNA, 26 bp, Artificial Sequence
  chemically treated genomic DNA (Homo sapiens)
gtagtagttagtttagtatttatttt

SEQ ID NO: 128 - DNA, 17 bp, Artificial Sequence
  chemically treated genomic DNA (Homo sapiens)
cccaccaaccatcatat

SEQ ID NO: 129 - DNA, 493 bp, Artificial Sequence
  chemically treated genomic DNA (Homo sapiens)
ccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccag

SEQ ID NO: 130 - DNA, 21 bp, Artificial Sequence
  chemically treated genomic DNA (Homo sapiens)
ccttctccaaaactcacccaa

SEQ ID NO: 131 - DNA, 22 bp, Artificial Sequence
  chemically treated genomic DNA (Homo sapiens)
ttgggggatagttttgggtata

SEQ ID NO: 132 - DNA, 427 bp, Artificial Sequence
  chemically treated genomic DNA (Homo sapiens)
tgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctg

SEQ ID NO: 133 - DNA, 22 bp, Artificial Sequence
  chemically treated genomic DNA (Homo sapiens)
tatacccaaaactatcccccaa

SEQ ID NO: 134 - DNA, 26 bp, Artificial Sequence
  chemically treated genomic DNA (Homo sapiens)
gtagtagttagtttagtatttatttt

SEQ ID NO: 135 - DNA, 556 bp, Artificial Sequence
  chemically treated genomic DNA (Homo sapiens)
gctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccat

SEQ ID NO: 136 - DNA, 21 bp, Artificial Sequence
  chemically treated genomic DNA (Homo sapiens)
ggttagttttgtattgtagga

SEQ ID NO: 137 - DNA, 25 bp, Artificial Sequence
  chemically treated genomic DNA (Homo sapiens)
ataaatttcccaaaataaaactata

SEQ ID NO: 138 - DNA, 555 bp, Artificial Sequence
  chemically treated genomic DNA (Homo sapiens)
cacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatgg

SEQ ID NO: 139 - DNA, 24 bp, Artificial Sequence
  chemically treated genomic DNA (Homo sapiens)
gtatagttttattttgggaaattt

SEQ ID NO: 140 - DNA, 21 bp, Artificial Sequence
  chemically treated genomic DNA (Homo sapiens)
ccattatataaacttcccctt

SEQ ID NO: 141 - DNA, 529 bp, Artificial Sequence
  chemically treated genomic DNA (Homo sapiens)
tgcaagttttgcatcctctcaccactgcctgcgttacccgagttgtaaagggcggctccctgtgtctgccccgctgcaccgatacaccgagctgcgcacggtgcccagcgcagggagaacaaatgatcatctgtccaacgcgcccatttacaggtgaggaaactaaggctccaactcaatcgacgcactctgcccttttgattaccagaaaagtagcaggacaggtgtcctgtcccgccctaccccggcccactaagccggcaccccggctccgacccccggctgtgcccggcgccgccgcggtgcccggcgccgccgcctcgcccggcggggccgcccggagcgcccgcacctccgcccgcttccacctggccgggcccgccccgcccggactcgggactgggaagtgcggcgactcccggaaccagccattggcgccagcgcggggagctgggggtgcagagctgcgggcgcggcgggccacgcaggcggcccccacccccggcctggcctggtctggtctggtctg

SEQ ID NO: 142 - DNA, 28 bp, Artificial Sequence
  chemically treated genomic DNA (Homo sapiens)
tgtaagttttgtatttttttattattgt

SEQ ID NO: 143 - DNA, 23 bp, Artificial Sequence
  chemically treated genomic DNA (Homo sapiens)
caaaccaaaccaaaccaaaccaa

SEQ ID NO: 144 - DNA, 550 bp, Artificial Sequence
  chemically treated genomic DNA (Homo sapiens)
gcctggcctggtctggtctggtctgcgctgccgcgcgggggcgccccctcccaggcccggcgcccgccagccccgctccgccaggtgcagcgcagcgcaggggtgggcgggggtggggctcggcgcgcacgttcacggggcggggagggggcgggtcaggggcgggaccacagccggctgggccggggttctatgcgcatctccggggaggggcggggcgggggcggggccggggcggggcccggtcggtgcactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggc

SEQ ID NO: 145 - DNA, 25 bp, Artificial Sequence
  chemically treated genomic DNA (Homo sapiens)
acctaacctaatctaatctaatcta

SEQ ID NO: 146 - DNA, 20 bp, Artificial Sequence
  chemically treated genomic DNA (Homo sapiens)
gttttgttttgggaggaatt

SEQ ID NO: 147 - DNA, 423 bp, Artificial Sequence
  chemically treated genomic DNA (Homo sapiens)
agttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgcggctgacatcctcactccacc

SEQ ID NO: 148 - DNA, 20 bp, Artificial Sequence
  chemically treated genomic DNA (Homo sapiens)
aattcctcccaaaacaaaac

SEQ ID NO: 149 - DNA, 20 bp, Artificial Sequence
  chemically treated genomic DNA (Homo sapiens)
ggtggagtgaggatgttagt

SEQ ID NO: 150 - DNA, 282 bp, Artificial Sequence
  chemically treated genomic DNA (Homo sapiens)
cctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgc

SEQ ID NO: 151 - DNA, 27 bp, Artificial Sequence
  chemically treated genomic DNA (Homo sapiens)
cctacctataaaaatcatataaaccaa

SEQ ID NO: 152 - DNA, 28 bp, Artificial Sequence
  chemically treated genomic DNA (Homo sapiens)
gtaatttatatggtgataggtatttata

SEQ ID NO: 153 - DNA, 459 bp, Artificial Sequence
  chemically treated genomic DNA (Homo sapiens)
gtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggag

SEQ ID NO: 154 - DNA, 26 bp, Artificial Sequence
  chemically treated genomic DNA (Homo sapiens)
gtgtggtaggaattttttaggaagtt

SEQ ID NO: 155 - DNA, 22 bp, Artificial Sequence
  chemically treated genomic DNA (Homo sapiens)
ctcctctctccacctcctccaa

SEQ ID NO: 156 - DNA, 260 bp, Artificial Sequence
  chemically treated genomic DNA (Homo sapiens)
gaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagg

SEQ ID NO: 157 - DNA, 27 bp, Artificial Sequence
  chemically treated genomic DNA (Homo sapiens)
gaagaaattagattagataaagagtgt

SEQ ID NO: 158 - DNA, 23 bp, Artificial Sequence
  chemically treated genomic DNA (Homo sapiens)
cctttacatacttattcccccaa

SEQ ID NO: 159 - DNA, 4133 bp, Homo Sapiens
aggaccaaaaactctttcttttaaaaagatcttagaagttcctcctccagagaagacagaaaacactgacaaaccgcacattgtgcagatgttcagccccgaaatgcagcctcgcagcccttcactccgcagtccaccggttgcatctgcacctccgggcagcgctcctgcagggcgcaaacacccagagacccagggacccggcagccccgcgcaggcctcccgcgtgcaccgctcagcgagcgggtctttcgcagacggcgggatgccccaggagaccgcgaggccggcgcagcccggcgagctcccggagggaaggcggcgtgtcagaaaggatcggaccccagcaatggccccggatcggtcccgcgcggtcgcctccttttcccgctccgccgccgggacccccctagccagtgctgaatttcccaactgggaaggaccgagtcactccaccctccgggaagtcgcgcgctcatccgttttcggcagcgccggagcccgagccggggaccgggcggacacccacagagtccgcaccgcagcgcgctgcacgctctcgcccccgcccgccggcccgcgccccagcgaactaaccgcaaagttggcccgaagtggcgacggcgctctcgtggagctcacccgccgtctcagcgcgcccccgagcagggaccgggcctgccggggccctcgccgggctcgcgcgtccgcatggtacctgccgcacgagccgctcccgcgccctctccccgcgcccggccgcccagctcggcgccggcgcctcacgctccccgagcgcaggagatccctccgccccggccccgcccgccggcgccggcgctcatttctcgggcgcggaaactcgagcccactttccccggctgccggctctgggaccgcgggctcggccacgcagtcccgcccggacccaaagagccccagtccctgcgaacaccaggtccgtgctgggagacgagaaggcgcccagcggggtctagcgcggctccgaggggcagggcgaggcttgtgatgccgaggttagttacggccagccacaggcgctgtgcaaggaattggggaaagctccctgccaagaaagggaaacgttagcttagctaaaaaaaaaaaaaaaaaaaaaaggctggggcctaatgagaaagcttcccagaggcatccctttagcttttccatagccttctgggagcccctgaatctgcatttgaatggcgcggctctgggtccgcgaaggtttggtgggctgaagtcgtccttcaggtctccaaaggaatgcagctaggtcggaatctacttcctccttcaatccccagaaaatggaaacgcttcccccgcgacctttttctgccgagttagaccccaggccctccccgccgcgggcgcctggcctcccccgctgacaccccggacgcccaggcctgtgggacaaaaggcagtcgcggcgtcccgcgggcttcctagcccgggagtcggccccaggggccccaaagcgtgaccccaggccgacaactgcaagttcctaggcagaggggaagccccagcgccgagaagcccgctccgagaactccccgcgccgggcgcccagcctgagcgtcccgggcgcggagcccatccccggtgcgggcagggctccagccgcaggctcggcgcagggcggactcggccgaagcccggagggccggaggcgctgggacgcagcccggacaagagggcggacttgatctcggaaagtttgtgggactcaggcattttaacactgggaagacaaagagatccgatttccctgggactggtgaggggagcttggcggggaggggaacggcagggcagtcaagtgtgaaagagaatttcctgggttcaaagttaacgcagtcaccttataagccatcttagaggtgaccggaaaaaataataataataaaggtgtctagcaggttgtggctgggaaggaaaaataatgcctgcaagatgagtgtgccgattcgtagccctatattccctgcccaccagttggaatacacatagattcacacatccagcaaatgcaaactccatcatccaaagacgtgtttgtcccggccataattgctccaagtgcttacaggtcaatttcatacatggaacacctcgaaagtgggtgacctgatctccaagcccaaccggcttgtgccgcttgccgaattgtaaatctcagcaaaacccaaacacaccggaactccagccgtttcctgggagcgaggaagcgggagtaatgctaaaaggggaaaagaagaacagtaaaaaaagtacaaagataccattccctgacgtaaaatcacgggattttttttaaatggcacaagagaattcctggagaagattaccattaattaataagtaataacgcttcctagggcttactagatgttttacatctgtctgggaatcccgattttccaggctccctgagaaatctatctgcctggaagaagttgcacttcgtcgccacaggagccgccgagagccagggatggagatttcagacttaggactctgccacgattctactgatccttaagcgccaacagaacgaaatggacatgcctattagctaccacaaatcgaattattttatatgagagagagaaatgtggttcaagttccacatttgtcctttaaataatcgaccctccctaaccctgtccccaaaggctcgtggaaattagggagggggttggggagacggttccagaaacaaaacgctttcctccagcacggcctctacatccagtccacccaagctgatttttgtaactcatataaagaatgggcccgggtgggtggtcagtgaagactggggtgagcaagcgcccacgtcgccgagcgccggggaggtccaggttcgcctccgcacagaaccctgcaaggagcgcgcctcgccaggtgcccggactagagggcgctgcgcccctgcaaatctcgcggccccgatgcgccctccctaggcaccattgctataataagttacattcaaaataatgcacaaacagcatcgcctctcaagttctttttaacagtgctctatatgtattttatgaactcccaaagctatgcatacgaatctttcatcgccgatccgcacaaagccagagggatgcgcagctcctggagccgagaacccgtagggcgcacacgcttccccgcactcgcttagagccacacaccccacgtaatttcattaacgtttaaacttaaatgccaaaaggcatgcacgatttgaacaaagaactcaccagtctagccgagtcctcggccctgggctctaaagtcctcggcagctccgtgatcccctcgcggtgtagatatgtgttaagagccgggtttgaagtaccaactttgcctccccgggatcttcagcatgtccctaaccagagtgccaacgtccgtgccgccgggacccaggcggccgcatctccggaggcttccgaccagggcaaacttaagcaccaaacgcaggcgaaaagagagtgcgcggggccggaacgagggcccgggagcagccaagtttgtcaggacgtgcccaggcagccagccgccgagttgaggagttgcggccgccggctgcggcgactcgctgcctctttccccactccctcccccttggaggcggtgggggaggggaggtgacgtcagcgccccgcctcgccccccgccccgggcgcggacgggattctccggctgggcgcgccaccccgacagtggcagcagcggccgtggaggctgcgggggtcccggcctctgcggtctctctggccggccgcagctgtggcgcgggtgaaacgcccgccctcctccttcggctgcgtctcccgggcgccggcgagcgcgggcgttcctcgcactcagcgcctggagccgcctggagccccgctgcgcgcacttccccggctcgcggagcccctccggcggcgtttcccacgccgcggactgcaggtgatgctcttcctcttctgcagccgaaattcgtcgcgatgtgtcgcctgccagatttttgctgggcggaagcatgaacagtctctgcagactggcctggacgacttgtactttgtggccctccaacttctggatgtgaatttttt

SEQ ID NO: 160 - DNA, 4318 bp, Homo Sapiens
cacacagttcatcagtgacagagcaagatgagacttgaactcatgtcattgacttccagtacagtttacacccctggttttacagatgaagaaactggccctaggagggataaatgacttgcccacttcattcaacaactgtgtaccaaacccatttccataagtgtgtcagcaggaccagctctgagcaaaaatgaaagtttagcaaagtttaacttttagcataccccatgtcttcatgattactctcacccgcaactgacacatacttttggtattctgtctcccagtcactccagaccatgcaatcttggcttggagacctggtttcacctactgtccctccacccccagcaactcaagaggtacaaaaaaaatccatctccaaatggccacatactgggcagggcaggggcaaagagaagtgactggtttccggttggaagaaggtggtttaccacccagctcttggctattgtttctcctcagactcagtgtagacaccctcaggctggcttcctcatctcctcccactgaggctaattactctgtcccattgcagggccccaggctctcccacctaaggtctgccccgctcccctagccccttccccagcagccccaagggtccagtctgtgtttgatcacccaggattattagatttcaaagctgtggaatcccataatttttacgagcatatgctctcctctagggtcttttcacgtctgaaaaggcggccagcagctccctgccacttctccacagtagcagtgcaggccagctgacaaggattacaaatccctagtgtctcatagctggcgcctagatagtgtgggtgacgggtagaataagagcccttgaagcaagttcagaaattctaataagctgaaatgcagcagagactgcagaggcacaaggaaagggattagatacccaaatcctgcaggggttcaggaggctatgcttcaaagcccctttgattcctgcctttcagctctctctagcggtcaccaagcgcaaagttctatgcctggttttcaagtcatttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaacaagtgtcagagtccgcgtccagctgagtgggtggggagagcagtactgggccgggccgcattcccgcccgggcctgtcagagcagcggacagacagcacctgtcgtgggcctcctcgttccctcactcctgccagagcctgtggcccccccgcggagaccggggactacacttgggagcatctttccccaactctcgtcaccgcagagaccgcgccgagcccacctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttcccccagtctccataaaaactctttcagaactccggggaatcaaccatgctggtgggagctcccagctcaggcctactcccccatctcacagttcccgatcacacaggggagcacgcgggatttcctaggcttgagaaccctcctccaagcctggacggagcctcaagagtggtgagaaggaccagattgactcgaagagccgccctcctcagtttgctcctctcctacactcctctaccctagtctccaccgacctgcttccttctgcgcttgcctagtggggggtgaaggagaggacaactaccttcacttctccccccaactttcacatacaccctccgtcccttaaggtggagtctcctgggaggcgggcagcctcgcagatccttctgccttaaggccttgcaaaggcagagtttcctcctgtcagtctggggtcttccagctccctgccgcatttgccacctcctcccacactcctttcatccttccccgcagcatatctggacatagaccacccctcgaccccgcaaaaaacaaaacaaaacaaaacaaaacaaagccttgagaaatctccaaacacctgtgcgtggacgaattacagttcacagttgctcctatatccctcatcacaattggccctccccccaaccgtgggaggcaactgctcttaagccgggttatagttgggggaattgaggaccggggggaactgaatgtgggttttgaacgcttctgcaaggccctttccaccccacttcacagaaagtagggaagtgagcaaatctctcattttccctgacttcagaaagcctgcttgctgctcctggagtcagcacctgctcctcccttgtccactctatcccccaatgaaggcactatttgggagtggcactacagccccaagatggaggcatggagggcagcagaagccgagccacagtccttgtgcaccccctggacttccccaaggagggcatgtggaagagaaagtctgcctttctctgggagtatgggtcattgtcttctaggttcctctcccccttaacatggaggaaaaactccaaaataagcttgcgtgtgctccactccctcagtccttctctcatgattcaataaaattatcatcactgagggctaatttccagggctttgcttgatgcccacaggccacaaaaggaagaattctttgggctggttatttggggacgggagggtgaggagcagctcatgggaggctctgctttcgtgagaaaggatttgcatgtctaagaggtcaacacagctagtccagggcttcctctcttccagacttccagccctgcatcaggctacagagaggaaatggcaaagagcagcaaatattatgcaaaagggtaaaggagctcccaagctaggagctgggagctcctgggaaaagaaaagggaagaacatgtctaaacccctgcccacagctgggcgtggtggctcacgcctgaaatcccagcactttgggaggccgaggcaggcagatcacctgaggtcgagagttcgagaccagcctgaccaacaaggagaaaccccatctctactaaaaatacaaaaaataaattagccgggcgtggtggcacatgcctgtaattcaagctactcaggaagctgaggcaggagaatcgcttgaacctgggaggtggaggttgtggtgagccgagatcacaccattgcactctag

SEQ ID NO: 161 - DNA, 3324 bp, Homo Sapiens
tctaaccttaacctttctacaggaataatgctaattagcgaggcttaatgagaacttcccccaggaagcgcagcccggtaggggcggccggactcgggcaaacgcagctccgggtgggagcagggtcacttctgctcccgagcggctggaataaaaatgcggattgcactcccccctcctccctatccaaagtgtccagccttgaagacaaggtggagggaggagagagagggcggaggtgtaaatccaacttaacccctgcgcgcgccctcgaggcggccggctgcccccgccccgccgtgtcccctcattaaggaaggccccttcgccaggggccgccaacgcccgcggcttccggtcagacggtgcacctgagagggacaccccgtcccctcccgggagggacccgggcctgctgaagtgggctcaactctgcaaaccgcgtctcaactccccgcgccgcgccggggaacccctccctgacactcaacgcttcccgtcctcacatccccaaacacagtccacttcccttctcgtggcggccgcggcaacccgagcccggcccccgccccgccgccagagaacgcctccctcgccgggacgcggtgccgagcccgctgcacaccgagcggccgtggcacaataccgcggcgctgcgcgcacaatcaccgccccccaggacccgcggcgcgcaccccgggagtggggtgcgccccgcgaccctgggcgctcagggccagacacacctcttgggcgccccgcggcccccacagtgcagccttcatcgccccccctccactctcgggcacactcacccgccccccgccccagcccactcggcccagggcgcagccgctcccccgcgccccctccctcagccccggcaaaggaagctccccctgcgcccccctccccagaaccgcccccagcccctcgcccccctaaccgcagctcaacggccggcggcagcagccggagaaggggggcggcggcccgggccccggaaacggcccgatcgccgggatccgggccggactccgtacctgggctggaagcgaggcggagatgggcggtcgggatccgcgagtgagcggggcgggcggcggtgacagccccacagctccagctgctgctgctgctgctgccgccgcggctgcccggggagaggggctggcaccaccgcggcgcgtcactgcccggcccgggggcgggggtggccaggaggagggcccaggcgagcagcggcggcagcggcggcggcgccgcggcccggaggaagggggagggggcaccgggcacggggaggcgggagagggggcgggaccgggcacggggcgggggcgggggggaggggagcgcagggagggcgcaggcagggggagtaggaggagcagcaggaggaggtggcggaggggcgggtgagagggaggagtgggcacggggggaaggggagagaggaaaaggaggcacccagggagaggggagaggagaaaggagggagagaggcgcggggggagaagaggaggaaggagggggagctgggccaggtagggggggataagggcgcgctggacgcgccgccgtgcgcttcggtggggagcgcgctcttaagggggaagcgcttcgaggaagatccttgcacggggctgagcccggaaagaaggcgctgggatctgtgcctacccatcgctcccggaggctgcggtctctgggtccggtgggggctggggggagagggcacccggcgggctgtctgcggtcaggccaggagagggagacttggcccaaataaagtgactcaggcaccctcaggaactctcggcgcccggggccccttcgggcagccttcgacccccatgcgtctttcgggtccccagggacgcgggtacttgtggggcggggctgccgggcctcggggttcggctcccccgggcggccggagcgagaccccgggctgggaaagccaggcacgtggccggctctcggccgtacccccgccccacccccacggcagggcccccagtgcttgatcaagttcaagctcgagctcctcggcgcgctgcccaccggctgcccctccgcgcccctcccccttccccatccgcaccgtctcgctcttcactcttcctttgtctctttcccaccacttagtttacaccccctccgccctcctccccgccccccgcgggcacccgagtgtccgggaggcgctcacctgttcgacccaaacatctacgcgacccccagcgcccgccgcccgcgtgcccgcccccgccccgccgccggtcattgtgctccgccagcccacaccgggccgggtcctgacggcgcgcgagccacagttgtaaagtaataggataatctcggggacgtcgctccagcccagacccgggcacgcactgtccgtggagacggcaccgccggggaggggagccacgcggattccagatgcggtcccccaggcggacagacccttgcccggggcgcaggaggaggcaggactggcatcgcggggtgggagccctggacctccgagcaacctcggactcggcccgaaaagcaacactctcatcaccaaaccgcagaattagaccccgatggagaaaatgggtcaggggatccattcccaccccacccctccaaatccagaccctccgctaccacagatcagcctcgaaaaaagcttgtgcttcaacaaggatggggaactgccctcgtggaattctgtggggaaattgccaaaaaaaaaaaaaaaaaaaaaaaaaaaaacaactaaaaaaaaaccctgataaggatcccacctcctgattcctctggtcgcatccgaagaggaagggcaatttctactgactctttacgctaccattcattcacggtggaaccagcagagaagagaaaacgagacagccacagcgattgtttgcaattttgaaacagactgcctttaaccctccaactttttttctgtaaaaagccttttttctttcttcctctgaaagctttgcattgtgaacaatccatggtaaacaaggctccctctacagccgcgagtgcgaagtacaaccccacaggttcagagcccagcgtttacccgtcagaaaaataaaatgatgacaagacatcacattagcgccacgcaggcttccttccgcacatgctcaagactctgctgtcaatagaaaactcacactttctttttaaaagagggtttaggcacatttactcatttgcaccttttattcctgaaatcaaatgtgttttcaaaccaattcactctccccagtttactggatcttctcatccttggtgatgtggggcaggtgg

SEQ ID NO: 162 - DNA, 4431 bp, Homo Sapiens
ccacagctaatgtttaacacttcaactcttccaggcccagaatcttcccaggactgactttgtgcttatttgtgccaaaatgtgttaaattagacaggaaggggaagcataaaattcaattcataatccaaggcaagaatctgagctttggtttgaaaaatgaaaagctatggagtgacataacatactccgacccttcaaacaatcaagatatttaactccaaagacatttctcaaataagagacagcccaagttcagactgcccacagggcaccagctcccagaaaaatgctatggccagagacagatctgaaatggagatacgtctcaagtccagagctctggagctactaccagacagcatgccaggagaagacaacgagaaaaaggagagatccacatcaatcctgttccatcccttctccggaggcacacagctctgggctgatccctgggatcagctgattcactggctgtgccctcttggtgcccgccgcctgcctggaaaggcagctgcctgctgaagaggaaaagttgggaacgcaattcctaattctcaggacaacgtctagtaccatgttctacctttaacctgtcttccctaaacggaaacagacaaggccatcctgaaattactcagctactcatgaaacagagtctacaattatttttccttccttttcaacacgattagaagggtgatcccccaaatgcggcctcttccacagccacgtccggaggggcatcccctagtgtcccagcaagtgccttcagcgacaccagaatgttagttaagacctaagacacatttctccagctgcctcccgccatttgtcacagaaaataatgctgctgcacgcccccaaaacgccgttttacaagcagacttggttttcagtaactggtgaggaaaagtcactggaaccaaacaccattcatacagctatccagagcggaggccaccgccctaccccggcagaggcacatgggggcagcaggcaggaccgagaggggctcgaaggcgccgcaggaggagaggctgggcgcagacggctcggccccaaaccacacccagcgccaggaaacgcaaggctcgggacgaacccttaagaagtcgctgctagggacagggaggttgggagcagggagtgacgccacaggaaccctgaatccccccgagtcccctcccaatcaagccaaggccgagcaaggggcgccccatgtaccgtaagccctcaacccaacactccggcaacgacaaacagaattccccgacctcaaaggccgtgaagcacgcgcccttcggggccctgagtgagccctcaaacctccgtgccgatcttccaaacccacctcccgccttcctggaatgggcgcacgcgaggcacggatttcaggaaacctctgccgtgacagctcacccacggtggaggcggaggcctgggacgctggacggagaaaggcggccagtggagggaggaggggtaggtcggcaacgcggtggcctcggacgtccgagctgcccggacgaagcgctggccccactcccgcccttggtcgccgcggtgaccccacccgagccgtgacctcccccaagatctcagggcccgggcctccccgctgcgccggccccagggtgccaccctcggacgcccagatgcgccctggaccctgcgccgggatcctgaacaccgccgcgccttcatcccgcgccgagcgcgcccggccctgctccggctgcagcgggcacgagccccaggcgggcggcggggacgcagcgcccgcagtgcgactggcgcagccgctgaggcacggggcgcgccgcccggaccccgaccccgcggcgctaggagaggcgcgggcgccggctggagagccgcacctcccgccccgccgaggctgctggccacgggcgcgctcgccccaagggccgggcggaggacctgtcccggattccagaggacgtgggtggggaagggacaaggatagggacaagggaggggacgcgaactgggccgaggtgtgggtcagtcctggttcgggaagggaggccgttggcagggccatcaggatcctctctggacatggaaggacgggtctgccctggacccagggattgggaaatgtgggttctctcagaacctggggaagtggggagagggtctgttctggagtgcggagggagatctattccgggcccaggacaatgggggtgggggcaggacgggaatgagggggcattcctggtgcagggaggggagacggagaagtagtagggggtctgctccgggcccgcgggctggggaccacgaagtgtaggagggcaccgtccaggaccgggatgaggagggagaggggcccgttgtggccctggatagagggggagggaaagtgcgccccggcccgagaggaggagcaggagggtcagtcctggacccgggcttaggaagccgggagggaggttcggatccgcctcagagacagggcgatgaagatctgtccaagtcttggagtggagggaaggatgtcggcggtgggggaagaggccggccacggacagggaaagggagtccgtcttgtagggcggacgggcggtcctggggaagggagaggccgcgacgcggggggcgtccggcccgagcggggccgctcaccttgggtttgtagagccactttcggaacctgttcatcatcgccgcgccggccctggccggactccgggcggccctcgccctccgcagcgctgcgcccgggcccggctgaggcgcggggcggacgcggaggcacggccggagcccccgcgctgtcgcagggaggctggctagcgaagcccggagcgccgagcgggcggcgggcaggtgcgcggggcaggtgcgcggccctgagtatgctctgcaagcggcgcgccgggcagacctcagacccgggagtgggcgctcgggcgcacggacagacgcgggcacgggggcgcgcggctcctcgctgctcactgacacccagcgctccgctggtcacggccgccccgcgccgcacatgcgcctagggcgccgcgagccccgggcccaccgcgcgctgcgggcggggcgggcggggcggaggcggcccaatccctgcgcgggcgccgcaccccgcccgaggcgcgctccctgccggcggggcgacccgccgcgcccgggtatccaagaaactacaagtcccgaaaggcatggcggggaggtggcgcccagggcttggcgtcccgggccgcgccgcggcgctgtgtattgtgggagttgtagtccacccgatggcggcggagcgtgccgccggttgctaggtgacgacgccaaacagccgcggcgtcctgcctaccgggagctgacggacgacgactgccaacaccttagccccagctggcccaggaaactgctgcggtggcaggtggcggcggcaggagggctcggctgccccgagcgcccgccaggtacgggggcgggacaggtgcggggcgacgcgccgccgattttcatgacctgccggccggttccctctcgctcgctgctcatcttgcttctcccaaacacctcttctgtcttcttcccagctccccgatgaaagtgaacggtgcctctttttttttttttaaatcaccactatcagcggtgcgttctaaaaagatactcttccgccctcgctactccccccagtggtgccctaatttgtaccttaaaacgctcacctcaatctgagtacctgctatgtgtcaagcagagagctaaaaacccacacgtggcctcacttaaacttcccattgacagccagagaagcaggcacaacgaggccggcgtgccctggctgtgggggttgcatccagatcacggcggatctgggtcggcctgaccccacagcgctgcacttttccctgccgcaccaccaccacgtctctggcttgttgtgaaacgtgcagatgtaagacacaggagatggaagtcatgcccccctcggttcagaattgagaagtctgacctgttcctgcttgtcctcactggccagtgccaggtgctcagaaaggtccgtgggctccatgaccactttattccaacagacgcgatgtgagcctaggcgcgctggcatctaagatttctcttagttgggggtagggtccatgtttatttttgagtaactgattgattttccctactctcctcttcctaccacccagtcgaccctctgaagggcaaaacccctctggagtttccccttatctccaattccttcccacttgttctttctggaaactactcccatcagattttcacccaaccactcctctgaagctctttatcaaagtcatccttgaccttgatgttgcaaaatccgatgatcggggtcagcgctcatctcttccttgaactgtcactaccacgtgacccagccgactgtgccctctc

SEQ ID NO: 163 - DNA, 3357 bp, Homo Sapiens
tgaaattcaaacataaaatccgctaataaggattaactgtatgtgcataatttaaacttcatccataaatttaaccacaccatttgattttaccagaatcaggctctaccccactcctgactctgcccactacccacccagtacctctggtaataggtgtctgagcgtccacaggtggcccctgacttgcgaaagacttcgcggcgcttccagccagggcccagggccgggcagtccagccagtcctcagccatggaggccacaggaagcagcagtagcctgaaagggggtggaagggatgagggaaactgaggctctaggaagggacaacactgtgccccaggccacacaaatcactggtatccattagtgcttgcccaagccctaggacctgccacaggcaaccagcccatatatggaaaagaaacccctcatattctcaccccattctttcctattctgggcctaggatatcatcattcctcaacccaaggatccctgtttcttattctcagtgtcctaatcccctactcctctctatcctcagactgacaacccatcatttctcctcactgccaatccagaaacttttcatccttccccctcattcctccctgtcactgacctaagggcctctatccctctattttatcaccccaagacccccatagtccccatcctcagccccaaagggccccatttctcttgccctcactacttgacttcagtagtctctcattccccccttccttgacccaggagttcctaatttccctccttcagtgttttaaccactccattccttctctgcctgatgtcctcttatcctgctacctcagtgttacaacctcgacttcctctgcgagacacaactgctccaacccatagcctgaacagcccctcatcttttccattcctcacactggaagcctcccatgcctccccttcctcagcccaagacctccccccttatttttcttctccttcaatgttctcacccacaatttctccctagtctgagctcccaaaccttcctctacagccaaaaagttccccacttctcctccttactgttctcatcctccattcctcccttatcatccagagagaccctaatttctcccctcagcattccgaaccctcctccattctctctgttcttgtcccgggatcatgccatccctaactgtcaccattctgatcccctactgctcctcgtcctctatatggggcctcctattcctccctttcagcattccaaagcctctatttctcctgtcatcagcctgagggcccctcatttctccctctcagagttctgaacccccatttctctctcaacttcagatgccccgatgtctccctttagcgttctgatctccaccattcctctccgtcctcgtcccaggatcccgacactcctacctgtcagagttcagagctgcattccttcccgtcctcagcctaaatccccccatttctcctcgtcagtattccgacgccgccattcctcccccttatcggcctgagggcccttcattcctccccgtcagcgttctgagccacaattccttcccatcctccgcctgagcgctctccacgtccagccccaaggctgtctcaccagtttggcaccaggccggtatcttccgccactctaggcccgtggacccatggcgagggtccctcctgcacctcccgcctcgccctcctccccttcctcctcctccgcggccgcctcctctgaagcggtagctgtcgcctccgcggctgttcgttgctcccggaaccggaagtccgctgcctgcctctcgggctccgcctctggctaagcacctgcgcactattgcctcgatgtcgcgtgcccttaatagggaggctcccgcgcctacgggccggcgctccgcagcggtgcgcgcgcccccctgccgagagccagttgcatctgcgtgctgacgttcaacgacagctaaccccttcgagggactggcagttgcggctctcctcgctgcccatctagctggcgcatgcgctttccagcctcaacctgaagggaagcggtcggggagggcttgcgcctgcgccctcccttccctcccgcggtctccacagccgataccgaacgcggcaaggaagctgcttcgcgcctgcgcactccctggccctgccggcgctctcctctcccacctctcgctggggtctatcctgtgttcgtgggtccctccgaacatcaaccccagggggggtcgtgtcccgctccctcctccccgccgaacagctgtgggagcgcgcggggcggggaaaggggcggtgccacaccgcaggtaaactgaggcacgcgggagggcgcgcccctgcaggaggcggatccccaacgtggggcttgtggggaaaaggcggggcctggcgtccacagcggacgacagctctgggtgggagacaggagcatgcatgggcggtgtcaccacactgaaggcgcgctgcgtagaccctctgcccgtgggaggctgggaatgtgggtccctgggctctcgcggggtgcaggcgccccccatcttatccagaagtctggaacagttgcaaccgcagcaatgtggagacagcttccttggtttcttcaaaattttattaacaaaacccagggagaggaggcaaggatgagtggactccgcagccccaccaggcactgaacatgtcgacggggacagtccctctgataaaggcagatgggcggtcaaccggtggatgggcacagggagaaccggagaaacagatgagtggaggaacggacacacgggcaccgggcggctcccccatctggaatgcagggtgtaaggggtccgggccaggaggctcagcggtcggcactggagcgcaggtcggtagtgaggggatcgtgctggatcgtctggtgcagcatcagggccagcaatcccgcgcggtttgtcatggctgtgcgcacattgcgctcctgctcaaacagctcgtccagcttgtaccactgccaagggagcggcaggagtcctaagcaggaacacctgcagccccgcctgccccggccacgtccgacatggaaacctaccacatgcagcaccaaaaccgcacagaaacctaccacacgcacgcgctccaagtccacttccgcacgccgcagcttctcccagcagtaatggcgattgcactggcgcttgggcaggcggcagaagtcacccgtgagctcaaagacatcacgtacaagggggcacccgcatacctcgtcagctggcacctgcaaggaggccaggttggggggatgaatagcggtgataagggagaataggaatgggggctcaaggagggagaaggaaaagaatggag

SEQ ID NO: 164 - DNA, 2170 bp, Homo Sapiens
gtgattttttttcttaggatttagcagtactccaccgcgctacagcagttagcatttctaaagcacacactccaacacccttcggccgtagcacattcaatccctccgccggggcgtgggggtctcctcccctccgagcacagtccccggcttcccgatttcctctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctccatcctacttcgttccagctcaatcagccccaccgccttcttccctcggagaaaaaagccacttcagagctccttgggcgccgttctcggctggaataaaagcgttaagaaacaggtggaaagcacttcacttctctaggcttcatatttctagggtggacagcccgctcctgctccggctctgccctcggcatcaataataactgaactcccacacgtgcacgtttctgtctctagcccgaccgaaaggaccaccccgcgggccctttaaaaggacgcgaccactcaggccaagtgggggtgggagagctcctggccgtcctcccttgggaaagtgcttcaactccccagtcccaaagtcctggagggcggagggcgcctcgtgagagttctcgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttccagcccggggctttgtgataactgggccgaaacccgagggtcctggagcgcggcgggtggcgggagcttgcggagcgcggcgcactcggcggccaggcatcggccagcccagcggcagccccctttctcctatttttatttttatttttggaaggagctgagaattagtcgattggttggcaggttgaattgccttctcttctatggcaatatgtgtcgtgacttttcaccttttgcctttggacaaaggtgaatggcaactgcgttggtcagtttttgttttctgttctgcggatgggttcgccgacgcagtaatcaaaattagagccactcttttggaagagcaaatcgttgttgttgcctccccagccccacggatcttactttgtgccattttcgggttgattttaactcgtttatttcagagctctttgcctcacctttatttttagatttagtcgtgtttgctgaaatatcagttgcttcttctgtgaatgaagtgtgggaacttgctctcgtcgcagttaatgaaatcaggaaaataaaaagatcaaaagggttggggatgggagaatgaagaggaatgtagacagatagtctagggccactcactggcttttggcgattcttagttccttaagctgattaaaacaatgtgaggaaatgtgggcttctccactttttaggaagaggtaataacgggcattttacgtggcgccacagcgtttgttttcaaagtttgaacgtgaatgtagcaagcataattttattaatgaaaatattctttagacaactgttaatattgacgaaagaagagaaacagagacacggaagctaaagagttgggaatcctaaaggtcaaaggatgtttctcagttactctgatgtcctgtgttttctttcagttggtacaaaatcgtgagtagtttaattatatcctgca

SEQ ID NO: 165 - DNA, 2251 bp, Homo Sapiens
ggaccccgagccgcccccaggtagccaggagcggcctcagcggcagccgcaaactccagtagccgcccgtgctgcccgtggctggggcggagggcagccagagctggggaccaaggctccgcgccacctgcgcgcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacaggtgagatggcgttgggctgacgttggggtcaacgggtagagaacgcagggatgcggccctcgccgaagagagccaagaagggaagagcgcgctctccaaattgcttttgtaacttgttttcagtgagcattttattgattcagaatctatcgagaatagcactagcgagctacttttcccttgagatgggtcttattcatcttggcaatggagtgagttggattgtggggaggaagaggaatgggaaaatcagtttataaatattaatgtcagcaagagtgtgctgttggcaggacgtatcgcgagcctggagattttggtggccgcagttggtaagtggctacaatccagaaagtaggatcgagttgctccccttgtcttatcagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcccacactgtttctcagagcaggcccaaccctctttgaagtcccaaccctaacgagatttagcaggtgctttgcccctacatcccccagtttatgttcccggaagcctgggtttctttctccaccgagacagcccttaccccttgctgcctgacactggccgagtcttccaagaaaaccccccgccccctctgttagacgtggaggggagcctgctgtagtgtgacttagcccattcctccgtactgtgaactgtgaactgca

SEQ ID NO: 166 - DNA, 2297 bp, Homo Sapiens
agaaaaacaccaccgtgtccccccgtttgcatttaatacactcaaggctcctcatttattcctctggaacaaattcccagcaaatattcacccatcgatttgggagcgatggatttttataaaggtttgatcgctttctaagtggtcgaagtgatttgtttccgtggtcttctcagtattgaagggggtgggggaagcggatttgagggggtgcatgtccttgccgtcggtgggctcactttctaaaaactattgagatgcgccagggtggccgtgaccaagcgggcccagggtcaactgtgtgagggggaagcgcccctcagagcgcgcgcagcgtcgggggtccagcttacgccgctgcgcgcccttgtgcgcaccgggtgaggatgccgagctctgcgggcatcccggaagccgcggtggaggcaggggccccgctcggcgcagtgggcctgctggggaggtgcaggggaggtcctgactcctggtctattcccttccagactttttcgttcgctcccggaccttcagggctctccctcaaactttctcctgcccccttcacgggaggttcctgtagcctctgggccttagggtcccgtaagcctcgggatcgacttgtgcccggggtgggtgtggcggaagcttgaatcggattacccaggtacgccacctgtagacgtagtgggcgagggggactttgctaccttctcagcttcttccctggaccccgcagcgaggggaaccaaatctctcccatgatagcccctctggcgtcagtctggaccgagtggctacaggttggactagggtaggcagaagatgcacttggcaccttaccgaacggtatttgaatccgtctccattactcattaatggcgtgaccttaggcaacccatctaaactttccgaacctcagcggtccccatctacaatatgggggttaatgataatgccttctccgcatgtaggtggattaaatggacataaagcgcctacccccgcccggcacgtccaaaactctcattaacaggtcagctaatcttattacgagaggaaccctccctcctccgcttcccagagtgtgggcggcatgaggccacggaagcagctgctgcaactagcatttcaaaatccagagactttctaatggtggcagggggtgaaagggtaggggggaggcagggttgggacaggtagaggtaggttcttggggacttccagtcttggggaccaagcgcttggaactagctgggtttgggcagaaacaagaaggcaaatgacgggaccgccgccggagtccggacttccatccctggagttcactgtctctcccagggaacagaggagtgtcctggtttctcagcaatgaaccaggagagtgtgagaaagagcatttgtttcttctcccgtggcccgacaagccactcttcggcagttctgcgagcagattaattgaaacgggcctggaacttcatcctctcctcccgatggagttgctggaggtctgcggacactgcctggttagcctccgggaccacagcgccgtgggctttccctcgtggtgtctgccttaaacttgggtgctatcaatctatccaacaatgacggatgaccttgtcataacgacgccagtcaaaacattttcggtctaactctcttccaaccaacatcgaagcatcctgaatgagacccggatgaagtctgaacagcacgtttcccaggttcagaaaacttgagtggtgggaagagaaaaagaaacaagcagaaatcaggaaagaatggctattaattgctcagattggcaagtgctaaataagttaggttgtttggaaaaagataaatgccgtttcttctctttacggtatggccagaaccccggcgatgggaaagtacctcctgagtcggtcaatttcacacaccctgcctgtgccctctaccatctactaccgaaaatgccaggaagagctggggggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcggcagccgcaggcagctgaccgcaaacagcctcgcccgtgtcccggagcagttgtgccaccagacgtaacactggatacttgtctccgggccccaagaaggagagggaaagagccctccagaagacaacccgagaaggggtcagcagagcgctgggtggagtgcagactcc

SEQ ID NO: 167 - DNA, 2590 bp, Homo Sapiens
gcgttgagcaggcgcggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttccttccctccccctccccctttcactcgccctcattgtcctgagtctttgaaagttgggagaatcggagatacttctgaggactggtaatgaagtctcacttaagtgggatgcaattcccgccctcctacccccctccaagaaggaggttgtgttttcattttgttttgctttgggtgctgacctttaaaaaattagagcaaaatgaacgtgaacaaaaagaaaaggagaaatgtttcgagctggggcagagggagcagagaaggagccctcaccgcggccggaatgcagagcggaccctggcccaggactgggtttccctttaggctcgggcctaccctggccctcgctgttggaatctccaggaggtaaagcgacctcgatttttgttgcccgcattcccgggcgtgagtgtccttcccaggaggctcaggaggccgtttctgttgcattctgagcctccgttgcaaaaactgaagcccgtgggtctcggcaggcctcctagctcgctcgccccgggacaggccctcgcctacacccctggaagtaaggagccccgggctctttcgtccttttcggggtgtggagcccctggggcccttgaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcagccaacccgagacttgcgtccctcgggcccggggcagctaggaggtcggcgcgcagcgggccgggtcaggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggctcgcctcacgtcggagctcgctcggcttgctaaatgagaggagctttgcaacggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtccggaagctcgggcgggggaatccgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagccggtggccgccgcgccgcgcgcctcccctgcccgcctttgtcgccgtccgaattcccatgctactctttttgacgggtcactggtggctctataggcaggtgctgccgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcg

SEQ ID NO: 168 - DNA, 4133 bp, Artificial Sequence
  chemically treated genomic DNA (Homo sapiens)
aggattaaaaatttttttttttaaaaagattttagaagttttttttttagagaagatagaaaatattgataaatcgtatattgtgtagatgtttagtttcgaaatgtagtttcgtagttttttatttcgtagtttatcggttgtatttgtattttcgggtagcgtttttgtagggcgtaaatatttagagatttagggattcggtagtttcgcgtaggtttttcgcgtgtatcgtttagcgagcgggtttttcgtagacggcgggatgttttaggagatcgcgaggtcggcgtagttcggcgagttttcggagggaaggcggcgtgttagaaaggatcggattttagtaatggtttcggatcggtttcgcgcggtcgtttttttttttcgtttcgtcgtcgggatttttttagttagtgttgaattttttaattgggaaggatcgagttattttatttttcgggaagtcgcgcgtttattcgttttcggtagcgtcggagttcgagtcggggatcgggcggatatttatagagttcgtatcgtagcgcgttgtacgttttcgttttcgttcgtcggttcgcgttttagcgaattaatcgtaaagttggttcgaagtggcgacggcgttttcgtggagtttattcgtcgttttagcgcgttttcgagtagggatcgggtttgtcggggttttcgtcgggttcgcgcgttcgtatggtatttgtcgtacgagtcgttttcgcgtttttttttcgcgttcggtcgtttagttcggcgtcggcgttttacgtttttcgagcgtaggagattttttcgtttcggtttcgttcgtcggcgtcggcgtttatttttcgggcgcggaaattcgagtttatttttttcggttgtcggttttgggatcgcgggttcggttacgtagtttcgttcggatttaaagagttttagtttttgcgaatattaggttcgtgttgggagacgagaaggcgtttagcggggtttagcgcggtttcgaggggtagggcgaggtttgtgatgtcgaggttagttacggttagttataggcgttgtgtaaggaattggggaaagttttttgttaagaaagggaaacgttagtttagttaaaaaaaaaaaaaaaaaaaaaaggttggggtttaatgagaaagttttttagaggtatttttttagtttttttatagttttttgggagtttttgaatttgtatttgaatggcgcggttttgggttcgcgaaggtttggtgggttgaagtcgttttttaggtttttaaaggaatgtagttaggtcggaatttatttttttttttaatttttagaaaatggaaacgtttttttcgcgatttttttttgtcgagttagattttaggtttttttcgtcgcgggcgtttggtttttttcgttgatatttcggacgtttaggtttgtgggataaaaggtagtcgcggcgtttcgcgggttttttagttcgggagtcggttttaggggttttaaagcgtgattttaggtcgataattgtaagtttttaggtagaggggaagttttagcgtcgagaagttcgtttcgagaatttttcgcgtcgggcgtttagtttgagcgtttcgggcgcggagtttattttcggtgcgggtagggttttagtcgtaggttcggcgtagggcggattcggtcgaagttcggagggtcggaggcgttgggacgtagttcggataagagggcggatttgatttcggaaagtttgtgggatttaggtattttaatattgggaagataaagagattcgatttttttgggattggtgaggggagtttggcggggaggggaacggtagggtagttaagtgtgaaagagaattttttgggtttaaagttaacgtagttattttataagttattttagaggtgatcggaaaaaataataataataaaggtgtttagtaggttgtggttgggaaggaaaaataatgtttgtaagatgagtgtgtcgattcgtagttttatattttttgtttattagttggaatatatatagatttatatatttagtaaatgtaaattttattatttaaagacgtgtttgtttcggttataattgttttaagtgtttataggttaattttatatatggaatatttcgaaagtgggtgatttgatttttaagtttaatcggtttgtgtcgtttgtcgaattgtaaattttagtaaaatttaaatatatcggaattttagtcgttttttgggagcgaggaagcgggagtaatgttaaaaggggaaaagaagaatagtaaaaaaagtataaagatattattttttgacgtaaaattacgggattttttttaaatggtataagagaatttttggagaagattattattaattaataagtaataacgttttttagggtttattagatgttttatatttgtttgggaatttcgattttttaggttttttgagaaatttatttgtttggaagaagttgtatttcgtcgttataggagtcgtcgagagttagggatggagattttagatttaggattttgttacgattttattgatttttaagcgttaatagaacgaaatggatatgtttattagttattataaatcgaattattttatatgagagagagaaatgtggtttaagttttatatttgttttttaaataatcgattttttttaattttgtttttaaaggttcgtggaaattagggagggggttggggagacggttttagaaataaaacgtttttttttagtacggtttttatatttagtttatttaagttgatttttgtaatttatataaagaatgggttcgggtgggtggttagtgaagattggggtgagtaagcgtttacgtcgtcgagcgtcggggaggtttaggttcgttttcgtatagaattttgtaaggagcgcgtttcgttaggtgttcggattagagggcgttgcgtttttgtaaatttcgcggtttcgatgcgttttttttaggtattattgttataataagttatatttaaaataatgtataaatagtatcgttttttaagttttttttaatagtgttttatatgtattttatgaatttttaaagttatgtatacgaattttttatcgtcgattcgtataaagttagagggatgcgtagtttttggagtcgagaattcgtagggcgtatacgttttttcgtattcgtttagagttatatattttacgtaattttattaacgtttaaatttaaatgttaaaaggtatgtacgatttgaataaagaatttattagtttagtcgagttttcggttttgggttttaaagttttcggtagtttcgtgattttttcgcggtgtagatatgtgttaagagtcgggtttgaagtattaattttgttttttcgggatttttagtatgtttttaattagagtgttaacgttcgtgtcgtcgggatttaggcggtcgtattttcggaggttttcgattagggtaaatttaagtattaaacgtaggcgaaaagagagtgcgcggggtcggaacgagggttcgggagtagttaagtttgttaggacgtgtttaggtagttagtcgtcgagttgaggagttgcggtcgtcggttgcggcgattcgttgtttttttttttatttttttttttttggaggcggtgggggaggggaggtgacgttagcgtttcgtttcgtttttcgtttcgggcgcggacgggatttttcggttgggcgcgttatttcgatagtggtagtagcggtcgtggaggttgcgggggtttcggtttttgcggtttttttggtcggtcgtagttgtggcgcgggtgaaacgttcgtttttttttttcggttgcgtttttcgggcgtcggcgagcgcgggcgtttttcgtatttagcgtttggagtcgtttggagtttcgttgcgcgtattttttcggttcgcggagttttttcggcggcgttttttacgtcgcggattgtaggtgatgtttttttttttttgtagtcgaaattcgtcgcgatgtgtcgtttgttagatttttgttgggcggaagtatgaatagtttttgtagattggtttggacgatttgtattttgtggttttttaatttttggatgtgaatttttt

SEQ ID NO: 169 - DNA, 4133 bp, Artificial Sequence
  chemically treated genomic DNA (Homo sapiens)
aaaaaatttatatttagaagttggagggttataaagtataagtcgtttaggttagtttgtagagattgtttatgttttcgtttagtaaaaatttggtaggcgatatatcgcgacgaatttcggttgtagaagaggaagagtattatttgtagttcgcggcgtgggaaacgtcgtcggaggggtttcgcgagtcggggaagtgcgcgtagcggggttttaggcggttttaggcgttgagtgcgaggaacgttcgcgttcgtcggcgttcgggagacgtagtcgaaggaggagggcgggcgttttattcgcgttatagttgcggtcggttagagagatcgtagaggtcgggattttcgtagtttttacggtcgttgttgttattgtcggggtggcgcgtttagtcggagaatttcgttcgcgttcggggcggggggcgaggcggggcgttgacgttatttttttttttttatcgtttttaagggggagggagtggggaaagaggtagcgagtcgtcgtagtcggcggtcgtaattttttaattcggcggttggttgtttgggtacgttttgataaatttggttgttttcgggttttcgtttcggtttcgcgtatttttttttcgtttgcgtttggtgtttaagtttgttttggtcggaagttttcggagatgcggtcgtttgggtttcggcggtacggacgttggtattttggttagggatatgttgaagatttcggggaggtaaagttggtattttaaattcggtttttaatatatatttatatcgcgaggggattacggagttgtcgaggattttagagtttagggtcgaggattcggttagattggtgagttttttgtttaaatcgtgtatgttttttggtatttaagtttaaacgttaatgaaattacgtggggtgtgtggttttaagcgagtgcggggaagcgtgtgcgttttacgggttttcggttttaggagttgcgtatttttttggttttgtgcggatcggcgatgaaagattcgtatgtatagttttgggagtttataaaatatatatagagtattgttaaaaagaatttgagaggcgatgttgtttgtgtattattttgaatgtaatttattatagtaatggtgtttagggagggcgtatcggggtcgcgagatttgtaggggcgtagcgttttttagttcgggtatttggcgaggcgcgttttttgtagggttttgtgcggaggcgaatttggattttttcggcgttcggcgacgtgggcgtttgtttattttagtttttattgattatttattcgggtttattttttatatgagttataaaaattagtttgggtggattggatgtagaggtcgtgttggaggaaagcgttttgtttttggaatcgtttttttaattttttttttaatttttacgagtttttggggatagggttagggagggtcgattatttaaaggataaatgtggaatttgaattatattttttttttttatataaaataattcgatttgtggtagttaataggtatgtttatttcgttttgttggcgtttaaggattagtagaatcgtggtagagttttaagtttgaaatttttatttttggttttcggcggtttttgtggcgacgaagtgtaattttttttaggtagatagattttttagggagtttggaaaatcgggatttttagatagatgtaaaatatttagtaagttttaggaagcgttattatttattaattaatggtaattttttttaggaatttttttgtgttatttaaaaaaaatttcgtgattttacgttagggaatggtatttttgtattttttttattgttttttttttttttttttagtattattttcgttttttcgtttttaggaaacggttggagtttcggtgtgtttgggttttgttgagatttataattcggtaagcggtataagtcggttgggtttggagattaggttatttattttcgaggtgttttatgtatgaaattgatttgtaagtatttggagtaattatggtcgggataaatacgtttttggatgatggagtttgtatttgttggatgtgtgaatttatgtgtattttaattggtgggtagggaatatagggttacgaatcggtatatttattttgtaggtattattttttttttttagttataatttgttagatatttttattattattatttttttcggttatttttaagatggtttataaggtgattgcgttaattttgaatttaggaaatttttttttatatttgattgttttgtcgttttttttttcgttaagttttttttattagttttagggaaatcggatttttttgtttttttagtgttaaaatgtttgagttttataaatttttcgagattaagttcgtttttttgttcgggttgcgttttagcgttttcggtttttcgggtttcggtcgagttcgttttgcgtcgagtttgcggttggagttttgttcgtatcggggatgggtttcgcgttcgggacgtttaggttgggcgttcggcgcggggagttttcggagcgggtttttcggcgttggggttttttttttgtttaggaatttgtagttgtcggtttggggttacgttttggggtttttggggtcgattttcgggttaggaagttcgcgggacgtcgcgattgttttttgttttataggtttgggcgttcggggtgttagcgggggaggttaggcgttcgcggcggggagggtttggggtttaattcggtagaaaaaggtcgcgggggaagcgtttttattttttggggattgaaggaggaagtagatttcgatttagttgtatttttttggagatttgaaggacgattttagtttattaaattttcgcggatttagagtcgcgttatttaaatgtagatttaggggtttttagaaggttatggaaaagttaaagggatgtttttgggaagtttttttattaggttttagttttttttttttttttttttttttagttaagttaacgttttttttttttggtagggagttttttttaattttttgtatagcgtttgtggttggtcgtaattaatttcggtattataagtttcgttttgtttttcggagtcgcgttagatttcgttgggcgttttttcgttttttagtacggatttggtgttcgtagggattggggttttttgggttcgggcgggattgcgtggtcgagttcgcggttttagagtcggtagtcggggaaagtgggttcgagttttcgcgttcgagaaatgagcgtcggcgtcggcgggcggggtcggggcggagggattttttgcgttcggggagcgtgaggcgtcggcgtcgagttgggcggtcgggcgcggggagagggcgcgggagcggttcgtgcggtaggtattatgcggacgcgcgagttcggcgagggtttcggtaggttcggtttttgttcgggggcgcgttgagacggcgggtgagttttacgagagcgtcgtcgttatttcgggttaattttgcggttagttcgttggggcgcgggtcggcgggcgggggcgagagcgtgtagcgcgttgcggtgcggattttgtgggtgttcgttcggttttcggttcgggtttcggcgttgtcgaaaacggatgagcgcgcgatttttcggagggtggagtgattcggttttttttagttgggaaatttagtattggttaggggggtttcggcggcggagcgggaaaaggaggcgatcgcgcgggatcgattcggggttattgttggggttcgattttttttgatacgtcgtttttttttcgggagttcgtcgggttgcgtcggtttcgcggttttttggggtatttcgtcgtttgcgaaagattcgttcgttgagcggtgtacgcgggaggtttgcgcggggttgtcgggtttttgggtttttgggtgtttgcgttttgtaggagcgttgttcggaggtgtagatgtaatcggtggattgcggagtgaagggttgcgaggttgtatttcggggttgaatatttgtataatgtgcggtttgttagtgttttttgttttttttggaggaggaatttttaagatttttttaaaagaaagagtttttggtttt

SEQ ID NO: 170 - DNA, 4318 bp, Artificial Sequence
  chemically treated genomic DNA (Homo sapiens)
tatatagtttattagtgatagagtaagatgagatttgaatttatgttattgatttttagtatagtttatatttttggttttatagatgaagaaattggttttaggagggataaatgatttgtttattttatttaataattgtgtattaaatttatttttataagtgtgttagtaggattagttttgagtaaaaatgaaagtttagtaaagtttaatttttagtatattttatgtttttatgattatttttattcgtaattgatatatatttttggtattttgttttttagttattttagattatgtaattttggtttggagatttggttttatttattgtttttttatttttagtaatttaagaggtataaaaaaaatttatttttaaatggttatatattgggtagggtaggggtaaagagaagtgattggttttcggttggaagaaggtggtttattatttagtttttggttattgtttttttttagatttagtgtagatatttttaggttggtttttttatttttttttattgaggttaattattttgttttattgtagggttttaggtttttttatttaaggtttgtttcgtttttttagttttttttttagtagttttaagggtttagtttgtgtttgattatttaggattattagattttaaagttgtggaattttataatttttacgagtatatgtttttttttagggtttttttacgtttgaaaaggcggttagtagttttttgttatttttttatagtagtagtgtaggttagttgataaggattataaatttttagtgttttatagttggcgtttagatagtgtgggtgacgggtagaataagagtttttgaagtaagtttagaaattttaataagttgaaatgtagtagagattgtagaggtataaggaaagggattagatatttaaattttgtaggggtttaggaggttatgttttaaagtttttttgatttttgttttttagttttttttagcggttattaagcgtaaagttttatgtttggtttttaagttatttaagtagttttttttagagatttgttgcgtgttagatattttgttagaattcgggaattttaggaatgaaaggaatataagtagaaaaaaattagaagaatataaagagtttgtattatttaatttttaagatattttttttttttttgggcgttagtatttagagagtatcgattttagcgttaaaattcggttttttttgaggtagattaggagttattacgtttttagtgaaatggaggcggtaggaattttatttttaatttttttttttttttttacgattattttttcgggggcgagagtcgttcggaagaattattcgcgtttcggtattggttttttgttgagttttagtcggataaaattagtcgattgtttatattaataagtgttagagttcgcgtttagttgagtgggtggggagagtagtattgggtcgggtcgtattttcgttcgggtttgttagagtagcggatagatagtatttgtcgtgggttttttcgtttttttatttttgttagagtttgtggttttttcgcggagatcggggattatatttgggagtatttttttttaattttcgttatcgtagagatcgcgtcgagtttatttgttaaatgttaatatattggaatgttaggggaggggaaaagaaggttgtatttttattttttttttttattatatatttattttttattgatttcgttacgattgggttttggtattcgggtttgggggtgttaatcgatattatttttcgttaggtttttatgtttattttatattttgggattgtttgggggtggatttggttttggcggtcgtttttggttttgtcgttggttttcggttattttgggcggggacgcggagagtggggttggtttttttttcgtcgcgggtttttatttatttttttatttgggaggggtaataattcgggagtcgcgttacggaaatgtatttttttttgttatttagacgggaattcgtttatttatgataatcgtttttttcgtttagggaaagggggcgggaagatttagtttcgggttttgttaattgttagtaagttagacggatagatagtagttgttgcgtgttcgagtttagttttttttcgatttttcgttttttatttttttgttcgttttatcgatattaggggtcgtagcggcgacggcgttttatttttagcgttcggttcggagttttcgaggtgattcgggttgggtttgtcgaggattttttataatcggcggttttttattttttttcgatcggtttcgtttttagcgttttaagagcgggattaggcggttgttagcgaaagatttataggagtttagattcgaggttcgttaggatgcggagattgagggcgggttcggtcgttaggaagcgttttcgttcggggtagtaattttttttcgtttttttttgtaatttttaattcgggagggttttacggggtttttttttttatatagtgggttagtttagtggggttgttttttgttaaagatttggtttattttttaagcgtttttttttttagtttttataaaaatttttttagaatttcggggaattaattatgttggtgggagtttttagtttaggtttatttttttattttatagttttcgattatataggggagtacgcgggattttttaggtttgagaatttttttttaagtttggacggagttttaagagtggtgagaaggattagattgattcgaagagtcgttttttttagtttgttttttttttatatttttttattttagtttttatcgatttgtttttttttgcgtttgtttagtggggggtgaaggagaggataattatttttatttttttttttaatttttatatatatttttcgttttttaaggtggagttttttgggaggcgggtagtttcgtagatttttttgttttaaggttttgtaaaggtagagtttttttttgttagtttggggttttttagttttttgtcgtatttgttatttttttttatattttttttattttttttcgtagtatatttggatatagattatttttcgatttcgtaaaaaataaaataaaataaaataaaataaagttttgagaaatttttaaatatttgtgcgtggacgaattatagtttatagttgtttttatattttttattataattggttttttttttaatcgtgggaggtaattgtttttaagtcgggttatagttgggggaattgaggatcggggggaattgaatgtgggttttgaacgtttttgtaaggttttttttattttattttatagaaagtagggaagtgagtaaattttttattttttttgattttagaaagtttgtttgttgtttttggagttagtatttgttttttttttgtttattttattttttaatgaaggtattatttgggagtggtattatagttttaagatggaggtatggagggtagtagaagtcgagttatagtttttgtgtattttttggatttttttaaggagggtatgtggaagagaaagtttgtttttttttgggagtatgggttattgttttttaggttttttttttttttaatatggaggaaaaattttaaaataagtttgcgtgtgttttatttttttagttttttttttatgatttaataaaattattattattgagggttaatttttagggttttgtttgatgtttataggttataaaaggaagaattttttgggttggttatttggggacgggagggtgaggagtagtttatgggaggttttgttttcgtgagaaaggatttgtatgtttaagaggttaatatagttagtttagggtttttttttttttagatttttagttttgtattaggttatagagaggaaatggtaaagagtagtaaatattatgtaaaagggtaaaggagtttttaagttaggagttgggagtttttgggaaaagaaaagggaagaatatgtttaaatttttgtttatagttgggcgtggtggtttacgtttgaaattttagtattttgggaggtcgaggtaggtagattatttgaggtcgagagttcgagattagtttgattaataaggagaaattttatttttattaaaaatataaaaaataaattagtcgggcgtggtggtatatgtttgtaatttaagttatttaggaagttgaggtaggagaatcgtttgaatttgggaggtggaggttgtggtgagtcgagattatattattgtattttag

SEQ ID NO: 171 - DNA, 4318 bp, Artificial Sequence
  chemically treated genomic DNA (Homo sapiens)
ttagagtgtaatggtgtgatttcggtttattataatttttattttttaggtttaagcgatttttttgttttagttttttgagtagtttgaattataggtatgtgttattacgttcggttaatttattttttgtatttttagtagagatggggtttttttttgttggttaggttggtttcgaattttcgattttaggtgatttgtttgtttcggttttttaaagtgttgggattttaggcgtgagttattacgtttagttgtgggtaggggtttagatatgttttttttttttttttttttaggagtttttagtttttagtttgggagtttttttatttttttgtataatatttgttgttttttgttattttttttttgtagtttgatgtagggttggaagtttggaagagaggaagttttggattagttgtgttgattttttagatatgtaaatttttttttacgaaagtagagttttttatgagttgttttttattttttcgtttttaaataattagtttaaagaatttttttttttgtggtttgtgggtattaagtaaagttttggaaattagtttttagtgatgataattttattgaattatgagagaaggattgagggagtggagtatacgtaagtttattttggagttttttttttatgttaagggggagaggaatttagaagataatgatttatatttttagagaaaggtagatttttttttttatatgttttttttggggaagtttagggggtgtataaggattgtggttcggtttttgttgttttttatgtttttattttggggttgtagtgttatttttaaatagtgtttttattgggggatagagtggataagggaggagtaggtgttgattttaggagtagtaagtaggttttttgaagttagggaaaatgagagatttgtttatttttttattttttgtgaagtggggtggaaagggttttgtagaagcgtttaaaatttatatttagtttttttcggtttttaatttttttaattataattcggtttaagagtagttgttttttacggttggggggagggttaattgtgatgagggatataggagtaattgtgaattgtaattcgtttacgtataggtgtttggagattttttaaggttttgttttgttttgttttgttttgttttttgcggggtcgaggggtggtttatgtttagatatgttgcggggaaggatgaaaggagtgtgggaggaggtggtaaatgcggtagggagttggaagattttagattgataggaggaaattttgtttttgtaaggttttaaggtagaaggatttgcgaggttgttcgttttttaggagattttattttaagggacggagggtgtatgtgaaagttggggggagaagtgaaggtagttgtttttttttttattttttattaggtaagcgtagaaggaagtaggtcggtggagattagggtagaggagtgtaggagaggagtaaattgaggagggcggtttttcgagttaatttggttttttttattatttttgaggtttcgtttaggtttggaggagggtttttaagtttaggaaatttcgcgtgtttttttgtgtgatcgggaattgtgagatgggggagtaggtttgagttgggagtttttattagtatggttgatttttcggagttttgaaagagtttttatggagattgggggaaggggcgtttgaagggtgggttaagtttttggtagaaagtagttttattgggttgatttattgtgtggaggaggaggtttcgtagggttttttcgggttggaggttgtagaggagggcggaggaggattgttgtttcgggcgggagcgttttttggcggtcgaattcgtttttagttttcgtattttggcgggtttcgagtttgggtttttgtaggtttttcgttagtagtcgtttgatttcgtttttgggacgttagggacgaggtcggtcgggagagaatagggggtcgtcgattgtaaaagattttcgataggtttagttcggattatttcgagggtttcggatcgagcgttgggggtggggcgtcgtcgtcgttacggtttttggtgtcggtggagcgagtagggaggtagagggcgggggatcgaggaggagttgagttcggatacgtagtagttgttgtttattcgtttggtttgttggtagttggtagggttcgaggttaggttttttcgttttttttttttaggcgggaagggcggttgttatgggtgggcggattttcgtttgaatagtaggggaagatgtattttcgtggcgcggttttcgggttattattttttttaaatggggaaatggatggagattcgcggcgggggaggagttaattttatttttcgcgttttcgtttaaggtggtcggaggttagcggtaggattaggagcgatcgttagggttaaatttatttttaggtagttttagagtgtggagtgggtatggggatttggcgggaaatagtgtcgattagtatttttaggttcggatgttagggtttagtcgtggcgaggttagtgaagggtgggtgtgtggtgggaaaggagagtagaagtgtaatttttttttttttttttttggtattttagtgtattaatatttggtaggtgggttcggcgcggtttttgcggtgacgagagttggggaaagatgtttttaagtgtagttttcggttttcgcgggggggttataggttttggtaggagtgagggaacgaggaggtttacgataggtgttgtttgttcgttgttttgataggttcgggcgggaatgcggttcggtttagtattgttttttttatttatttagttggacgcggattttgatatttgttagtgtgagtaatcgattaattttattcggttggggtttagtaggaaattaatgtcgaggcgcgggtagttttttcgggcgattttcgttttcgggaggatagtcgtggggagaggaagaggggttgggggtgggatttttgtcgtttttattttattgggggcgtggtggtttttgatttgttttagagaggatcgaattttggcgttaaggtcggtattttttgggtattggcgtttagagaagaaaagggtattttggaagttaggtagtataaattttttgtgtttttttggtttttttttatttatgttttttttatttttgaagttttcggattttagtagagtgtttgatacgtagtaggtttttagaaaagattgtttaaatgatttgaaaattaggtatagaattttgcgtttggtgatcgttagagagagttgaaaggtaggaattaaaggggttttgaagtatagttttttgaatttttgtaggatttgggtatttaatttttttttttgtgtttttgtagtttttgttgtattttagtttattagaatttttgaatttgttttaagggtttttattttattcgttatttatattatttaggcgttagttatgagatattagggatttgtaatttttgttagttggtttgtattgttattgtggagaagtggtagggagttgttggtcgtttttttagacgtgaaaagattttagaggagagtatatgttcgtaaaaattatgggattttatagttttgaaatttaataattttgggtgattaaatatagattggatttttggggttgttggggaaggggttaggggagcggggtagattttaggtgggagagtttggggttttgtaatgggatagagtaattagttttagtgggaggagatgaggaagttagtttgagggtgtttatattgagtttgaggagaaataatagttaagagttgggtggtaaattatttttttttaatcggaaattagttatttttttttgtttttgttttgtttagtatgtggttatttggagatggattttttttgtattttttgagttgttgggggtggagggatagtaggtgaaattaggtttttaagttaagattgtatggtttggagtgattgggagatagaatattaaaagtatgtgttagttgcgggtgagagtaattatgaagatatggggtatgttaaaagttaaattttgttaaatttttatttttgtttagagttggttttgttgatatatttatggaaatgggtttggtatatagttgttgaatgaagtgggtaagttatttattttttttagggttagtttttttatttgtaaaattaggggtgtaaattgtattggaagttaatgatatgagtttaagttttattttgttttgttattgatgaattgtgtg

SEQ ID NO: 172 - DNA, 3324 bp, Artificial Sequence
  chemically treated genomic DNA (Homo sapiens)
tttaattttaatttttttataggaataatgttaattagcgaggtttaatgagaattttttttaggaagcgtagttcggtaggggcggtcggattcgggtaaacgtagtttcgggtgggagtagggttatttttgttttcgagcggttggaataaaaatgcggattgtattttttttttttttttatttaaagtgtttagttttgaagataaggtggagggaggagagagagggcggaggtgtaaatttaatttaatttttgcgcgcgttttcgaggcggtcggttgttttcgtttcgtcgtgtttttttattaaggaaggttttttcgttaggggtcgttaacgttcgcggttttcggttagacggtgtatttgagagggatatttcgttttttttcgggagggattcgggtttgttgaagtgggtttaattttgtaaatcgcgttttaatttttcgcgtcgcgtcggggaatttttttttgatatttaacgtttttcgtttttatatttttaaatatagtttattttttttttcgtggcggtcgcggtaattcgagttcggttttcgtttcgtcgttagagaacgtttttttcgtcgggacgcggtgtcgagttcgttgtatatcgagcggtcgtggtataatatcgcggcgttgcgcgtataattatcgttttttaggattcgcggcgcgtatttcgggagtggggtgcgtttcgcgattttgggcgtttagggttagatatattttttgggcgtttcgcggtttttatagtgtagtttttatcgttttttttttattttcgggtatatttattcgtttttcgttttagtttattcggtttagggcgtagtcgttttttcgcgtttttttttttagtttcggtaaaggaagttttttttgcgtttttttttttagaatcgtttttagtttttcgtttttttaatcgtagtttaacggtcggcggtagtagtcggagaaggggggcggcggttcgggtttcggaaacggttcgatcgtcgggattcgggtcggatttcgtatttgggttggaagcgaggcggagatgggcggtcgggattcgcgagtgagcggggcgggcggcggtgatagttttatagttttagttgttgttgttgttgttgtcgtcgcggttgttcggggagaggggttggtattatcgcggcgcgttattgttcggttcgggggcgggggtggttaggaggagggtttaggcgagtagcggcggtagcggcggcggcgtcgcggttcggaggaagggggagggggtatcgggtacggggaggcgggagagggggcgggatcgggtacggggcgggggcgggggggaggggagcgtagggagggcgtaggtagggggagtaggaggagtagtaggaggaggtggcggaggggcgggtgagagggaggagtgggtacggggggaaggggagagaggaaaaggaggtatttagggagaggggagaggagaaaggagggagagaggcgcggggggagaagaggaggaaggagggggagttgggttaggtagggggggataagggcgcgttggacgcgtcgtcgtgcgtttcggtggggagcgcgtttttaagggggaagcgtttcgaggaagatttttgtacggggttgagttcggaaagaaggcgttgggatttgtgtttatttatcgttttcggaggttgcggtttttgggttcggtgggggttggggggagagggtattcggcgggttgtttgcggttaggttaggagagggagatttggtttaaataaagtgatttaggtatttttaggaattttcggcgttcggggttttttcgggtagttttcgatttttatgcgtttttcgggtttttagggacgcgggtatttgtggggcggggttgtcgggtttcggggttcggttttttcgggcggtcggagcgagatttcgggttgggaaagttaggtacgtggtcggttttcggtcgtattttcgttttatttttacggtagggtttttagtgtttgattaagtttaagttcgagtttttcggcgcgttgtttatcggttgttttttcgcgttttttttttttttttattcgtatcgtttcgttttttattttttttttgttttttttttattatttagtttatatttttttcgttttttttttcgtttttcgcgggtattcgagtgttcgggaggcgtttatttgttcgatttaaatatttacgcgatttttagcgttcgtcgttcgcgtgttcgttttcgtttcgtcgtcggttattgtgtttcgttagtttatatcgggtcgggttttgacggcgcgcgagttatagttgtaaagtaataggataatttcggggacgtcgttttagtttagattcgggtacgtattgttcgtggagacggtatcgtcggggaggggagttacgcggattttagatgcggttttttaggcggatagatttttgttcggggcgtaggaggaggtaggattggtatcgcggggtgggagttttggattttcgagtaatttcggattcggttcgaaaagtaatatttttattattaaatcgtagaattagatttcgatggagaaaatgggttaggggatttatttttattttatttttttaaatttagatttttcgttattatagattagtttcgaaaaaagtttgtgttttaataaggatggggaattgttttcgtggaattttgtggggaaattgttaaaaaaaaaaaaaaaaaaaaaaaaaaaaataattaaaaaaaaattttgataaggattttattttttgatttttttggtcgtattcgaagaggaagggtaatttttattgattttttacgttattatttatttacggtggaattagtagagaagagaaaacgagatagttatagcgattgtttgtaattttgaaatagattgtttttaattttttaattttttttttgtaaaaagttttttttttttttttttttgaaagttttgtattgtgaataatttatggtaaataaggttttttttatagtcgcgagtgcgaagtataattttataggtttagagtttagcgtttattcgttagaaaaataaaatgatgataagatattatattagcgttacgtaggttttttttcgtatatgtttaagattttgttgttaatagaaaatttatattttttttttaaaagagggtttaggtatatttatttatttgtattttttatttttgaaattaaatgtgtttttaaattaatttattttttttagtttattggatttttttatttttggtgatgtggggtaggtgg

SEQ ID NO: 173 - DNA, 3324 bp, Artificial Sequence
  chemically treated genomic DNA (Homo sapiens)
ttatttgttttatattattaaggatgagaagatttagtaaattggggagagtgaattggtttgaaaatatatttgattttaggaataaaaggtgtaaatgagtaaatgtgtttaaatttttttttaaaaagaaagtgtgagttttttattgatagtagagttttgagtatgtgcggaaggaagtttgcgtggcgttaatgtgatgttttgttattattttatttttttgacgggtaaacgttgggttttgaatttgtggggttgtatttcgtattcgcggttgtagagggagttttgtttattatggattgtttataatgtaaagtttttagaggaagaaagaaaaaaggttttttatagaaaaaaagttggagggttaaaggtagtttgttttaaaattgtaaataatcgttgtggttgtttcgtttttttttttttgttggttttatcgtgaatgaatggtagcgtaaagagttagtagaaattgtttttttttttcggatgcgattagaggaattaggaggtgggatttttattagggtttttttttagttgtttttttttttttttttttttttttttttggtaatttttttatagaattttacgagggtagttttttatttttgttgaagtataagtttttttcgaggttgatttgtggtagcggagggtttggatttggaggggtggggtgggaatggattttttgatttattttttttatcggggtttaattttgcggtttggtgatgagagtgttgtttttcgggtcgagttcgaggttgttcggaggtttagggtttttatttcgcgatgttagttttgtttttttttgcgtttcgggtaagggtttgttcgtttgggggatcgtatttggaattcgcgtggttttttttttcggcggtgtcgtttttacggatagtgcgtgttcgggtttgggttggagcgacgttttcgagattattttattattttataattgtggttcgcgcgtcgttaggattcggttcggtgtgggttggcggagtataatgatcggcggcggggcgggggcgggtacgcgggcggcgggcgttgggggtcgcgtagatgtttgggtcgaataggtgagcgtttttcggatattcgggtgttcgcggggggcggggaggagggcggagggggtgtaaattaagtggtgggaaagagataaaggaagagtgaagagcgagacggtgcggatggggaagggggaggggcgcggaggggtagtcggtgggtagcgcgtcgaggagttcgagtttgaatttgattaagtattgggggttttgtcgtgggggtggggcgggggtacggtcgagagtcggttacgtgtttggtttttttagttcggggtttcgtttcggtcgttcgggggagtcgaatttcgaggttcggtagtttcgttttataagtattcgcgtttttggggattcgaaagacgtatgggggtcgaaggttgttcgaaggggtttcgggcgtcgagagtttttgagggtgtttgagttattttatttgggttaagttttttttttttggtttgatcgtagatagttcgtcgggtgttttttttttttagtttttatcggatttagagatcgtagttttcgggagcgatgggtaggtatagattttagcgtttttttttcgggtttagtttcgtgtaaggatttttttcgaagcgttttttttttaagagcgcgttttttatcgaagcgtacggcggcgcgtttagcgcgtttttatttttttttatttggtttagttttttttttttttttttttttttttttcgcgttttttttttttttttttttttttttttttttttgggtgtttttttttttttttttttttttttttcgtgtttattttttttttttattcgttttttcgttatttttttttgttgttttttttattttttttgtttgcgttttttttgcgtttttttttttttcgttttcgtttcgtgttcggtttcgttttttttttcgttttttcgtgttcggtgtttttttttttttttttcgggtcgcggcgtcgtcgtcgttgtcgtcgttgttcgtttgggttttttttttggttattttcgttttcgggtcgggtagtgacgcgtcgcggtggtgttagttttttttttcgggtagtcgcggcggtagtagtagtagtagtagttggagttgtggggttgttatcgtcgttcgtttcgtttattcgcggatttcgatcgtttattttcgtttcgtttttagtttaggtacggagttcggttcggatttcggcgatcgggtcgttttcggggttcgggtcgtcgtttttttttttcggttgttgtcgtcggtcgttgagttgcggttaggggggcgaggggttgggggcggttttggggaggggggcgtagggggagttttttttgtcggggttgagggagggggcgcgggggagcggttgcgttttgggtcgagtgggttggggcggggggcgggtgagtgtgttcgagagtggagggggggcgatgaaggttgtattgtgggggtcgcggggcgtttaagaggtgtgtttggttttgagcgtttagggtcgcggggcgtattttattttcggggtgcgcgtcgcgggttttggggggcggtgattgtgcgcgtagcgtcgcggtattgtgttacggtcgttcggtgtgtagcgggttcggtatcgcgtttcggcgagggaggcgttttttggcggcggggcgggggtcgggttcgggttgtcgcggtcgttacgagaagggaagtggattgtgtttggggatgtgaggacgggaagcgttgagtgttagggaggggtttttcggcgcggcgcggggagttgagacgcggtttgtagagttgagtttattttagtaggttcgggtttttttcgggaggggacggggtgttttttttaggtgtatcgtttgatcggaagtcgcgggcgttggcggtttttggcgaaggggttttttttaatgaggggatacggcggggcgggggtagtcggtcgtttcgagggcgcgcgtaggggttaagttggatttatattttcgtttttttttttttttttttattttgtttttaaggttggatattttggatagggaggaggggggagtgtaattcgtatttttattttagtcgttcgggagtagaagtgattttgtttttattcggagttgcgtttgttcgagttcggtcgtttttatcgggttgcgttttttgggggaagtttttattaagtttcgttaattagtattatttttgtagaaaggttaaggttaga

SEQ ID NO: 174 - DNA, 4431 bp, Artificial Sequence
  chemically treated genomic DNA (Homo sapiens)
ttatagttaatgtttaatattttaatttttttaggtttagaatttttttaggattgattttgtgtttatttgtgttaaaatgtgttaaattagataggaaggggaagtataaaatttaatttataatttaaggtaagaatttgagttttggtttgaaaaatgaaaagttatggagtgatataatatatttcgattttttaaataattaagatatttaattttaaagatattttttaaataagagatagtttaagtttagattgtttatagggtattagtttttagaaaaatgttatggttagagatagatttgaaatggagatacgttttaagtttagagttttggagttattattagatagtatgttaggagaagataacgagaaaaaggagagatttatattaattttgttttatttttttttcggaggtatatagttttgggttgatttttgggattagttgatttattggttgtgtttttttggtgttcgtcgtttgtttggaaaggtagttgtttgttgaagaggaaaagttgggaacgtaatttttaatttttaggataacgtttagtattatgttttatttttaatttgttttttttaaacggaaatagataaggttattttgaaattatttagttatttatgaaatagagtttataattattttttttttttttttaatacgattagaagggtgattttttaaatgcggttttttttatagttacgttcggaggggtattttttagtgttttagtaagtgtttttagcgatattagaatgttagttaagatttaagatatatttttttagttgtttttcgttatttgttatagaaaataatgttgttgtacgtttttaaaacgtcgttttataagtagatttggtttttagtaattggtgaggaaaagttattggaattaaatattatttatatagttatttagagcggaggttatcgttttatttcggtagaggtatatgggggtagtaggtaggatcgagaggggttcgaaggcgtcgtaggaggagaggttgggcgtagacggttcggttttaaattatatttagcgttaggaaacgtaaggttcgggacgaatttttaagaagtcgttgttagggatagggaggttgggagtagggagtgacgttataggaattttgaattttttcgagtttttttttaattaagttaaggtcgagtaaggggcgttttatgtatcgtaagtttttaatttaatatttcggtaacgataaatagaatttttcgattttaaaggtcgtgaagtacgcgtttttcggggttttgagtgagtttttaaattttcgtgtcgattttttaaatttatttttcgtttttttggaatgggcgtacgcgaggtacggattttaggaaatttttgtcgtgatagtttatttacggtggaggcggaggtttgggacgttggacggagaaaggcggttagtggagggaggaggggtaggtcggtaacgcggtggtttcggacgttcgagttgttcggacgaagcgttggttttattttcgtttttggtcgtcgcggtgattttattcgagtcgtgattttttttaagattttagggttcgggttttttcgttgcgtcggttttagggtgttattttcggacgtttagatgcgttttggattttgcgtcgggattttgaatatcgtcgcgtttttatttcgcgtcgagcgcgttcggttttgtttcggttgtagcgggtacgagttttaggcgggcggcggggacgtagcgttcgtagtgcgattggcgtagtcgttgaggtacggggcgcgtcgttcggatttcgatttcgcggcgttaggagaggcgcgggcgtcggttggagagtcgtatttttcgtttcgtcgaggttgttggttacgggcgcgttcgttttaagggtcgggcggaggatttgtttcggattttagaggacgtgggtggggaagggataaggatagggataagggaggggacgcgaattgggtcgaggtgtgggttagttttggttcgggaagggaggtcgttggtagggttattaggattttttttggatatggaaggacgggtttgttttggatttagggattgggaaatgtgggtttttttagaatttggggaagtggggagagggtttgttttggagtgcggagggagatttatttcgggtttaggataatgggggtgggggtaggacgggaatgagggggtatttttggtgtagggaggggagacggagaagtagtagggggtttgtttcgggttcgcgggttggggattacgaagtgtaggagggtatcgtttaggatcgggatgaggagggagaggggttcgttgtggttttggatagagggggagggaaagtgcgtttcggttcgagaggaggagtaggagggttagttttggattcgggtttaggaagtcgggagggaggttcggattcgttttagagatagggcgatgaagatttgtttaagttttggagtggagggaaggatgtcggcggtgggggaagaggtcggttacggatagggaaagggagttcgttttgtagggcggacgggcggttttggggaagggagaggtcgcgacgcggggggcgttcggttcgagcggggtcgtttattttgggtttgtagagttattttcggaatttgtttattatcgtcgcgtcggttttggtcggatttcgggcggttttcgtttttcgtagcgttgcgttcgggttcggttgaggcgcggggcggacgcggaggtacggtcggagttttcgcgttgtcgtagggaggttggttagcgaagttcggagcgtcgagcgggcggcgggtaggtgcgcggggtaggtgcgcggttttgagtatgttttgtaagcggcgcgtcgggtagattttagattcgggagtgggcgttcgggcgtacggatagacgcgggtacgggggcgcgcggtttttcgttgtttattgatatttagcgtttcgttggttacggtcgtttcgcgtcgtatatgcgtttagggcgtcgcgagtttcgggtttatcgcgcgttgcgggcggggcgggcggggcggaggcggtttaatttttgcgcgggcgtcgtatttcgttcgaggcgcgttttttgtcggcggggcgattcgtcgcgttcgggtatttaagaaattataagtttcgaaaggtatggcggggaggtggcgtttagggtttggcgtttcgggtcgcgtcgcggcgttgtgtattgtgggagttgtagtttattcgatggcggcggagcgtgtcgtcggttgttaggtgacgacgttaaatagtcgcggcgttttgtttatcgggagttgacggacgacgattgttaatattttagttttagttggtttaggaaattgttgcggtggtaggtggcggcggtaggagggttcggttgtttcgagcgttcgttaggtacgggggcgggataggtgcggggcgacgcgtcgtcgatttttatgatttgtcggtcggttttttttcgttcgttgtttattttgttttttttaaatattttttttgttttttttttagtttttcgatgaaagtgaacggtgtttttttttttttttttaaattattattattagcggtgcgttttaaaaagatattttttcgttttcgttattttttttagtggtgttttaatttgtattttaaaacgtttattttaatttgagtatttgttatgtgttaagtagagagttaaaaatttatacgtggttttatttaaattttttattgatagttagagaagtaggtataacgaggtcggcgtgttttggttgtgggggttgtatttagattacggcggatttgggtcggtttgattttatagcgttgtatttttttttgtcgtattattattacgtttttggtttgttgtgaaacgtgtagatgtaagatataggagatggaagttatgtttttttcggtttagaattgagaagtttgatttgtttttgtttgtttttattggttagtgttaggtgtttagaaaggttcgtgggttttatgattattttattttaatagacgcgatgtgagtttaggcgcgttggtatttaagattttttttagttgggggtagggtttatgtttatttttgagtaattgattgattttttttatttttttttttttattatttagtcgattttttgaagggtaaaatttttttggagtttttttttatttttaatttttttttatttgttttttttggaaattatttttattagatttttatttaattatttttttgaagttttttattaaagttatttttgattttgatgttgtaaaattcgatgatcggggttagcgtttattttttttttgaattgttattattacgtgatttagtcgattgtgttttttt

SEQ ID NO: 175 - DNA, 4431 bp, Artificial Sequence
  chemically treated genomic DNA (Homo sapiens)
gagagggtatagtcggttgggttacgtggtagtgatagtttaaggaagagatgagcgttgatttcgattatcggattttgtaatattaaggttaaggatgattttgataaagagttttagaggagtggttgggtgaaaatttgatgggagtagtttttagaaagaataagtgggaaggaattggagataaggggaaattttagaggggttttgttttttagagggtcgattgggtggtaggaagaggagagtagggaaaattaattagttatttaaaaataaatatggattttatttttaattaagagaaattttagatgttagcgcgtttaggtttatatcgcgtttgttggaataaagtggttatggagtttacggatttttttgagtatttggtattggttagtgaggataagtaggaataggttagattttttaattttgaatcgaggggggtatgatttttattttttgtgttttatatttgtacgttttataataagttagagacgtggtggtggtgcggtagggaaaagtgtagcgttgtggggttaggtcgatttagattcgtcgtgatttggatgtaatttttatagttagggtacgtcggtttcgttgtgtttgtttttttggttgttaatgggaagtttaagtgaggttacgtgtgggtttttagttttttgtttgatatatagtaggtatttagattgaggtgagcgttttaaggtataaattagggtattattggggggagtagcgagggcggaagagtatttttttagaacgtatcgttgatagtggtgatttaaaaaaaaaaaaagaggtatcgtttatttttatcggggagttgggaagaagatagaagaggtgtttgggagaagtaagatgagtagcgagcgagagggaatcggtcggtaggttatgaaaatcggcggcgcgtcgtttcgtatttgtttcgttttcgtatttggcgggcgttcggggtagtcgagtttttttgtcgtcgttatttgttatcgtagtagttttttgggttagttggggttaaggtgttggtagtcgtcgttcgttagttttcggtaggtaggacgtcgcggttgtttggcgtcgttatttagtaatcggcggtacgtttcgtcgttatcgggtggattataatttttataatatatagcgtcgcggcgcggttcgggacgttaagttttgggcgttattttttcgttatgtttttcgggatttgtagttttttggatattcgggcgcggcgggtcgtttcgtcggtagggagcgcgtttcgggcggggtgcggcgttcgcgtagggattgggtcgttttcgtttcgttcgtttcgttcgtagcgcgcggtgggttcggggttcgcggcgttttaggcgtatgtgcggcgcggggcggtcgtgattagcggagcgttgggtgttagtgagtagcgaggagtcgcgcgttttcgtgttcgcgtttgttcgtgcgttcgagcgtttattttcgggtttgaggtttgttcggcgcgtcgtttgtagagtatatttagggtcgcgtatttgtttcgcgtatttgttcgtcgttcgttcggcgtttcgggtttcgttagttagtttttttgcgatagcgcgggggtttcggtcgtgttttcgcgttcgtttcgcgttttagtcgggttcgggcgtagcgttgcggagggcgagggtcgttcggagttcggttagggtcggcgcggcgatgatgaataggtttcgaaagtggttttataaatttaaggtgagcggtttcgttcgggtcggacgtttttcgcgtcgcggttttttttttttttaggatcgttcgttcgttttataagacggattttttttttttgttcgtggtcggtttttttttttatcgtcgatatttttttttttattttaagatttggatagatttttatcgttttgtttttgaggcggattcgaatttttttttcggttttttaagttcgggtttaggattgatttttttgttttttttttcgggtcggggcgtattttttttttttttttatttagggttataacgggtttttttttttttttatttcggttttggacggtgtttttttatatttcgtggtttttagttcgcgggttcggagtagattttttattattttttcgttttttttttttgtattaggaatgtttttttattttcgttttgtttttatttttattgttttgggttcggaatagattttttttcgtattttagaatagattttttttttatttttttaggttttgagagaatttatattttttaatttttgggtttagggtagattcgtttttttatgtttagagaggattttgatggttttgttaacggttttttttttcgaattaggattgatttatatttcggtttagttcgcgtttttttttttgtttttatttttgttttttttttatttacgttttttggaattcgggataggtttttcgttcggtttttggggcgagcgcgttcgtggttagtagtttcggcggggcgggaggtgcggttttttagtcggcgttcgcgttttttttagcgtcgcggggtcggggttcgggcggcgcgtttcgtgttttagcggttgcgttagtcgtattgcgggcgttgcgttttcgtcgttcgtttggggttcgtgttcgttgtagtcggagtagggtcgggcgcgttcggcgcgggatgaaggcgcggcggtgtttaggatttcggcgtagggtttagggcgtatttgggcgttcgagggtggtattttggggtcggcgtagcggggaggttcgggttttgagattttgggggaggttacggttcgggtggggttatcgcggcgattaagggcgggagtggggttagcgtttcgttcgggtagttcggacgttcgaggttatcgcgttgtcgatttattttttttttttttattggtcgttttttttcgtttagcgttttaggttttcgtttttatcgtgggtgagttgttacggtagaggttttttgaaattcgtgtttcgcgtgcgtttattttaggaaggcgggaggtgggtttggaagatcggtacggaggtttgagggtttatttagggtttcgaagggcgcgtgttttacggtttttgaggtcggggaattttgtttgtcgttgtcggagtgttgggttgagggtttacggtatatggggcgttttttgttcggttttggtttgattgggaggggattcggggggatttagggtttttgtggcgttattttttgtttttaatttttttgtttttagtagcgattttttaagggttcgtttcgagttttgcgttttttggcgttgggtgtggtttggggtcgagtcgtttgcgtttagtttttttttttgcggcgttttcgagtttttttcggttttgtttgttgtttttatgtgtttttgtcggggtagggcggtggttttcgttttggatagttgtatgaatggtgtttggttttagtgatttttttttattagttattgaaaattaagtttgtttgtaaaacggcgttttgggggcgtgtagtagtattattttttgtgataaatggcgggaggtagttggagaaatgtgttttaggttttaattaatattttggtgtcgttgaaggtatttgttgggatattaggggatgttttttcggacgtggttgtggaagaggtcgtatttgggggattatttttttaatcgtgttgaaaaggaaggaaaaataattgtagattttgttttatgagtagttgagtaattttaggatggttttgtttgttttcgtttagggaagataggttaaaggtagaatatggtattagacgttgttttgagaattaggaattgcgtttttaattttttttttttagtaggtagttgtttttttaggtaggcggcgggtattaagagggtatagttagtgaattagttgattttagggattagtttagagttgtgtgttttcggagaagggatggaataggattgatgtggattttttttttttttcgttgtttttttttggtatgttgtttggtagtagttttagagttttggatttgagacgtatttttattttagatttgtttttggttatagtatttttttgggagttggtgttttgtgggtagtttgaatttgggttgttttttatttgagaaatgtttttggagttaaatattttgattgtttgaagggtcggagtatgttatgttattttatagttttttattttttaaattaaagtttagatttttgttttggattatgaattgaattttatgttttttttttttgtttaatttaatatattttggtataaataagtataaagttagttttgggaagattttgggtttggaagagttgaagtgttaaatattagttgtgg

SEQ ID NO: 176 - DNA, 3357 bp, Artificial Sequence
  chemically treated genomic DNA (Homo sapiens)
tgaaatttaaatataaaattcgttaataaggattaattgtatgtgtataatttaaattttatttataaatttaattatattatttgattttattagaattaggttttattttatttttgattttgtttattatttatttagtatttttggtaataggtgtttgagcgtttataggtggtttttgatttgcgaaagatttcgcggcgtttttagttagggtttagggtcgggtagtttagttagtttttagttatggaggttataggaagtagtagtagtttgaaagggggtggaagggatgagggaaattgaggttttaggaagggataatattgtgttttaggttatataaattattggtatttattagtgtttgtttaagttttaggatttgttataggtaattagtttatatatggaaaagaaattttttatatttttattttatttttttttattttgggtttaggatattattattttttaatttaaggatttttgttttttatttttagtgttttaattttttatttttttttatttttagattgataatttattatttttttttattgttaatttagaaattttttattttttttttttatttttttttgttattgatttaagggtttttatttttttattttattattttaagatttttatagtttttatttttagttttaaagggttttattttttttgtttttattatttgattttagtagttttttattttttttttttttgatttaggagtttttaattttttttttttagtgttttaattattttattttttttttgtttgatgtttttttattttgttattttagtgttataatttcgattttttttgcgagatataattgttttaatttatagtttgaatagttttttattttttttattttttatattggaagttttttatgtttttttttttttagtttaagatttttttttttatttttttttttttttaatgtttttatttataatttttttttagtttgagtttttaaatttttttttatagttaaaaagttttttattttttttttttattgtttttattttttattttttttttattatttagagagattttaatttttttttttagtatttcgaatttttttttattttttttgtttttgtttcgggattatgttatttttaattgttattattttgattttttattgtttttcgttttttatatggggttttttattttttttttttagtattttaaagtttttattttttttgttattagtttgagggttttttattttttttttttagagttttgaatttttattttttttttaattttagatgtttcgatgtttttttttagcgttttgatttttattattttttttcgttttcgttttaggatttcgatatttttatttgttagagtttagagttgtattttttttcgtttttagtttaaatttttttattttttttcgttagtatttcgacgtcgttattttttttttttatcggtttgagggttttttattttttttcgttagcgttttgagttataatttttttttatttttcgtttgagcgttttttacgtttagttttaaggttgttttattagtttggtattaggtcggtatttttcgttattttaggttcgtggatttatggcgagggttttttttgtatttttcgtttcgtttttttttttttttttttttttcgcggtcgttttttttgaagcggtagttgtcgttttcgcggttgttcgttgttttcggaatcggaagttcgttgtttgtttttcgggtttcgtttttggttaagtatttgcgtattattgtttcgatgtcgcgtgtttttaatagggaggttttcgcgtttacgggtcggcgtttcgtagcggtgcgcgcgtttttttgtcgagagttagttgtatttgcgtgttgacgtttaacgatagttaattttttcgagggattggtagttgcggtttttttcgttgtttatttagttggcgtatgcgttttttagttttaatttgaagggaagcggtcggggagggtttgcgtttgcgtttttttttttttttcgcggtttttatagtcgatatcgaacgcggtaaggaagttgtttcgcgtttgcgtattttttggttttgtcggcgttttttttttttatttttcgttggggtttattttgtgttcgtgggttttttcgaatattaattttagggggggtcgtgtttcgttttttttttttcgtcgaatagttgtgggagcgcgcggggcggggaaaggggcggtgttatatcgtaggtaaattgaggtacgcgggagggcgcgtttttgtaggaggcggatttttaacgtggggtttgtggggaaaaggcggggtttggcgtttatagcggacgatagttttgggtgggagataggagtatgtatgggcggtgttattatattgaaggcgcgttgcgtagattttttgttcgtgggaggttgggaatgtgggtttttgggttttcgcggggtgtaggcgttttttattttatttagaagtttggaatagttgtaatcgtagtaatgtggagatagtttttttggtttttttaaaattttattaataaaatttagggagaggaggtaaggatgagtggatttcgtagttttattaggtattgaatatgtcgacggggatagtttttttgataaaggtagatgggcggttaatcggtggatgggtatagggagaatcggagaaatagatgagtggaggaacggatatacgggtatcgggcggtttttttatttggaatgtagggtgtaaggggttcgggttaggaggtttagcggtcggtattggagcgtaggtcggtagtgaggggatcgtgttggatcgtttggtgtagtattagggttagtaatttcgcgcggtttgttatggttgtgcgtatattgcgtttttgtttaaatagttcgtttagtttgtattattgttaagggagcggtaggagttttaagtaggaatatttgtagtttcgtttgtttcggttacgttcgatatggaaatttattatatgtagtattaaaatcgtatagaaatttattatacgtacgcgttttaagtttattttcgtacgtcgtagttttttttagtagtaatggcgattgtattggcgtttgggtaggcggtagaagttattcgtgagtttaaagatattacgtataagggggtattcgtatatttcgttagttggtatttgtaaggaggttaggttggggggatgaatagcggtgataagggagaataggaatgggggtttaaggagggagaaggaaaagaatggag

SEQ ID NO: 177 - DNA, 3357 bp, Artificial Sequence
  chemically treated genomic DNA (Homo sapiens)
ttttatttttttttttttttttttttgagtttttatttttatttttttttattatcgttatttatttttttaatttggtttttttgtaggtgttagttgacgaggtatgcgggtgtttttttgtacgtgatgtttttgagtttacgggtgatttttgtcgtttgtttaagcgttagtgtaatcgttattattgttgggagaagttgcggcgtgcggaagtggatttggagcgcgtgcgtgtggtaggtttttgtgcggttttggtgttgtatgtggtaggtttttatgtcggacgtggtcggggtaggcggggttgtaggtgtttttgtttaggatttttgtcgtttttttggtagtggtataagttggacgagttgtttgagtaggagcgtaatgtgcgtatagttatgataaatcgcgcgggattgttggttttgatgttgtattagacgatttagtacgatttttttattatcgatttgcgttttagtgtcgatcgttgagttttttggttcggattttttatattttgtattttagatgggggagtcgttcggtgttcgtgtgttcgtttttttatttatttgttttttcggttttttttgtgtttatttatcggttgatcgtttatttgtttttattagagggattgttttcgtcgatatgtttagtgtttggtggggttgcggagtttatttatttttgttttttttttttgggttttgttaataaaattttgaagaaattaaggaagttgtttttatattgttgcggttgtaattgttttagatttttggataagatggggggcgtttgtatttcgcgagagtttagggatttatatttttagttttttacgggtagagggtttacgtagcgcgtttttagtgtggtgatatcgtttatgtatgtttttgttttttatttagagttgtcgttcgttgtggacgttaggtttcgttttttttttataagttttacgttggggattcgttttttgtaggggcgcgttttttcgcgtgttttagtttatttgcggtgtggtatcgttttttttttcgtttcgcgcgtttttatagttgttcggcggggaggagggagcgggatacgattttttttggggttgatgttcggagggatttacgaatataggatagattttagcgagaggtgggagaggagagcgtcggtagggttagggagtgcgtaggcgcgaagtagtttttttgtcgcgttcggtatcggttgtggagatcgcgggagggaagggagggcgtaggcgtaagtttttttcgatcgtttttttttaggttgaggttggaaagcgtatgcgttagttagatgggtagcgaggagagtcgtaattgttagtttttcgaaggggttagttgtcgttgaacgttagtacgtagatgtaattggttttcggtaggggggcgcgcgtatcgttgcggagcgtcggttcgtaggcgcgggagtttttttattaagggtacgcgatatcgaggtaatagtgcgtaggtgtttagttagaggcggagttcgagaggtaggtagcggattttcggtttcgggagtaacgaatagtcgcggaggcgatagttatcgttttagaggaggcggtcgcggaggaggaggaaggggaggagggcgaggcgggaggtgtaggagggattttcgttatgggtttacgggtttagagtggcggaagatatcggtttggtgttaaattggtgagatagttttggggttggacgtggagagcgtttaggcggaggatgggaaggaattgtggtttagaacgttgacggggaggaatgaagggtttttaggtcgataagggggaggaatggcggcgtcggaatattgacgaggagaaatggggggatttaggttgaggacgggaaggaatgtagttttgaattttgataggtaggagtgtcgggattttgggacgaggacggagaggaatggtggagattagaacgttaaagggagatatcggggtatttgaagttgagagagaaatgggggtttagaattttgagagggagaaatgaggggtttttaggttgatgataggagaaatagaggttttggaatgttgaaagggaggaataggaggttttatatagaggacgaggagtagtaggggattagaatggtgatagttagggatggtatgatttcgggataagaatagagagaatggaggagggttcggaatgttgaggggagaaattagggtttttttggatgataagggaggaatggaggatgagaatagtaaggaggagaagtggggaattttttggttgtagaggaaggtttgggagtttagattagggagaaattgtgggtgagaatattgaaggagaagaaaaataaggggggaggttttgggttgaggaaggggaggtatgggaggtttttagtgtgaggaatggaaaagatgaggggttgtttaggttatgggttggagtagttgtgtttcgtagaggaagtcgaggttgtaatattgaggtagtaggataagaggatattaggtagagaaggaatggagtggttaaaatattgaaggagggaaattaggaatttttgggttaaggaaggggggaatgagagattattgaagttaagtagtgagggtaagagaaatggggttttttggggttgaggatggggattatgggggttttggggtgataaaatagagggatagaggtttttaggttagtgatagggaggaatgagggggaaggatgaaaagtttttggattggtagtgaggagaaatgatgggttgttagtttgaggatagagaggagtaggggattaggatattgagaataagaaatagggatttttgggttgaggaatgatgatattttaggtttagaataggaaagaatggggtgagaatatgaggggttttttttttatatatgggttggttgtttgtggtaggttttagggtttgggtaagtattaatggatattagtgatttgtgtggtttggggtatagtgttgtttttttttagagttttagttttttttattttttttatttttttttaggttattgttgttttttgtggtttttatggttgaggattggttggattgttcggttttgggttttggttggaagcgtcgcgaagtttttcgtaagttaggggttatttgtggacgtttagatatttattattagaggtattgggtgggtagtgggtagagttaggagtggggtagagtttgattttggtaaaattaaatggtgtggttaaatttatggatgaagtttaaattatgtatatatagttaatttttattagcggattttatgtttgaatttta

SEQ ID NO: 178 - DNA, 2170 bp, Artificial Sequence
  chemically treated genomic DNA (Homo sapiens)
gtgatttttttttttaggatttagtagtattttatcgcgttatagtagttagtatttttaaagtatatattttaatatttttcggtcgtagtatatttaattttttcgtcggggcgtgggggttttttttttttcgagtatagttttcggtttttcgattttttttgttttattttttcgttttttaagtatattgtgtttatttttttaggtagtttttttagcggtcgggtagtagtagggtttcgagttcgtttttttcggggcggttatacgtgtttattttttggggttggggatcgtttttttcgtttggttgttgattggtgtttttttttattttatttttttcgtcgttttttagtttttattttatttcgttttagtttaattagttttatcgtttttttttttcggagaaaaaagttattttagagttttttgggcgtcgttttcggttggaataaaagcgttaagaaataggtggaaagtattttatttttttaggttttatatttttagggtggatagttcgtttttgtttcggttttgttttcggtattaataataattgaatttttatacgtgtacgtttttgtttttagttcgatcgaaaggattatttcgcgggttttttaaaaggacgcgattatttaggttaagtgggggtgggagagtttttggtcgtttttttttgggaaagtgttttaattttttagttttaaagttttggagggcggagggcgtttcgtgagagttttcgggggtgcggttcgcgttttttgggttttgcggatttgggttcgggggcgcgcgtttcgtttttttttttttttggcggtgtagttgttcgggcgggggtggggcgggggtcggggttcgcgtgggattaattaggatcggggcgggagtcgatcgcggtcggcggggagggttagtttcgttttggcgggcgggcgcgtggtaggggttttcggaggtttcgagttttcgggaggcgtttcggttaatttcgggtcggtggggatcgggtttgggcgcggggttttgaaggtgtggaaggaaagtttgggatttcgttatttttttatagcgttttttttttcgtaatatttagtttttttatcgcggggttcgggagtttttggagttgatttcgttattattattttttcgggcgagcgcggaggacgggttggttattttggttaggtcggaggtgttttttagttcggggttttgtgataattgggtcgaaattcgagggttttggagcgcggcgggtggcgggagtttgcggagcgcggcgtattcggcggttaggtatcggttagtttagcggtagtttttttttttttatttttatttttatttttggaaggagttgagaattagtcgattggttggtaggttgaattgtttttttttttatggtaatatgtgtcgtgattttttattttttgtttttggataaaggtgaatggtaattgcgttggttagtttttgttttttgttttgcggatgggttcgtcgacgtagtaattaaaattagagttatttttttggaagagtaaatcgttgttgttgtttttttagttttacggattttattttgtgttattttcgggttgattttaattcgtttattttagagttttttgttttatttttatttttagatttagtcgtgtttgttgaaatattagttgttttttttgtgaatgaagtgtgggaatttgttttcgtcgtagttaatgaaattaggaaaataaaaagattaaaagggttggggatgggagaatgaagaggaatgtagatagatagtttagggttatttattggtttttggcgatttttagttttttaagttgattaaaataatgtgaggaaatgtgggtttttttattttttaggaagaggtaataacgggtattttacgtggcgttatagcgtttgtttttaaagtttgaacgtgaatgtagtaagtataattttattaatgaaaatattttttagataattgttaatattgacgaaagaagagaaatagagatacggaagttaaagagttgggaattttaaaggttaaaggatgttttttagttattttgatgttttgtgtttttttttagttggtataaaatcgtgagtagtttaattatattttgta

SEQ ID NO: 179 - DNA, 2170 bp, Artificial Sequence
  chemically treated genomic DNA (Homo sapiens)
tgtaggatataattaaattatttacgattttgtattaattgaaagaaaatataggatattagagtaattgagaaatattttttgatttttaggatttttaattttttagttttcgtgtttttgttttttttttttcgttaatattaatagttgtttaaagaatatttttattaataaaattatgtttgttatatttacgtttaaattttgaaaataaacgttgtggcgttacgtaaaatgttcgttattatttttttttaaaaagtggagaagtttatatttttttatattgttttaattagtttaaggaattaagaatcgttaaaagttagtgagtggttttagattatttgtttatatttttttttatttttttatttttaatttttttgatttttttatttttttgattttattaattgcgacgagagtaagtttttatattttatttatagaagaagtaattgatattttagtaaatacgattaaatttaaaaataaaggtgaggtaaagagttttgaaataaacgagttaaaattaattcgaaaatggtataaagtaagattcgtggggttggggaggtaataataacgatttgtttttttaaaagagtggttttaattttgattattgcgtcggcgaatttattcgtagaatagaaaataaaaattgattaacgtagttgttatttatttttgtttaaaggtaaaaggtgaaaagttacgatatatattgttatagaagagaaggtaatttaatttgttaattaatcgattaatttttagttttttttaaaaataaaaataaaaataggagaaagggggttgtcgttgggttggtcgatgtttggtcgtcgagtgcgtcgcgtttcgtaagttttcgttattcgtcgcgttttaggattttcgggtttcggtttagttattataaagtttcgggttggaaaatattttcggtttggttagaatggttagttcgtttttcgcgttcgttcggggggataatggtggcgagattaattttaagggttttcgagtttcgcgataaagaggttggatattacgggaggaaggacgttgtggaagaataacggagttttaaattttttttttatatttttagagtttcgcgtttaggttcggtttttatcggttcgaagttggtcggagcgtttttcgggagttcggggttttcgggagtttttgttacgcgttcgttcgttagagcggggttagtttttttcgtcggtcgcggtcgattttcgtttcggttttagttaattttacgcgggtttcggttttcgttttattttcgttcggatagttgtatcgttagggagggggaggggcggggcgcgcgttttcgggtttagattcgtaggatttagggggcgcgggtcgtattttcgagaatttttacgaggcgtttttcgttttttaggattttgggattggggagttgaagtatttttttaagggaggacggttaggagtttttttatttttatttggtttgagtggtcgcgtttttttaaagggttcgcggggtggttttttcggtcgggttagagatagaaacgtgtacgtgtgggagtttagttattattgatgtcgagggtagagtcggagtaggagcgggttgtttattttagaaatatgaagtttagagaagtgaagtgttttttatttgttttttaacgtttttattttagtcgagaacggcgtttaaggagttttgaagtggttttttttttcgagggaagaaggcggtggggttgattgagttggaacgaagtaggatggaggttggagagcggcgggaagggtggggtagggggaggtattaattagtagttaagcgggaagagcgatttttaattttagggaatggatacgtgtgatcgtttcggagaagacgggttcggaattttgttattgttcggtcgttgaaagagttgtttggaagagtgagtataatgtgtttggaaggcggggggatggggtagaggaaatcgggaagtcggggattgtgttcggaggggaggagatttttacgtttcggcggagggattgaatgtgttacggtcgaagggtgttggagtgtgtgttttagaaatgttaattgttgtagcgcggtggagtattgttaaattttaagaaaaaaaattat

SEQ ID NO: 180 - DNA, 2251 bp, Artificial Sequence
  chemically treated genomic DNA (Homo sapiens)
ggatttcgagtcgtttttaggtagttaggagcggttttagcggtagtcgtaaattttagtagtcgttcgtgttgttcgtggttggggcggagggtagttagagttggggattaaggtttcgcgttatttgcgcgtatagttttatatttgaacgttgttttttcgtagacgagatcggcgggtattgtaaagttgggattcgtttttgaaggaaaaaaaatagcgagtaagaaatttagtattattttttattgatttatttcgttgtattttttgttttttaagtttttgaaagttggtaattttgatttcggtgtttaaaaatcgatagttattgagatcggttttgagaagtcgaagatttggtagtttttagattgagtaggataaggtgaaagtaggttggaggcgggtttaggatatttgagggttgattttgggggttcgtgaggttgttatcgttgttgtcgttataggtgagatggcgttgggttgacgttggggttaacgggtagagaacgtagggatgcggttttcgtcgaagagagttaagaagggaagagcgcgttttttaaattgtttttgtaatttgtttttagtgagtattttattgatttagaatttatcgagaatagtattagcgagttattttttttttgagatgggttttatttattttggtaatggagtgagttggattgtggggaggaagaggaatgggaaaattagtttataaatattaatgttagtaagagtgtgttgttggtaggacgtatcgcgagtttggagattttggtggtcgtagttggtaagtggttataatttagaaagtaggatcgagttgttttttttgttttattagtgtatcgtttttcgggcgcgggtttaatattttataagtggtaattttcgtttacggtagttttgttttttttttattatttttagatttagttttgtattttaaggttgcgtatcgttagttattattatgtttattttcggggttaattcgttcgtttttttgagtttcgatcggttgaatagtttagtgattatttcggcggtgatgtttattttcggggtggtgggtaatttggtggttatcgtggtgttgtgtaagtcgcgtaaggagtagaaggagacgattttttatacgttggtatgtgggttggttgttatcgatttgttgggtattttgttggtgagttcggtgattatcgttacgtatatgaagggttaatggttcgggggttagtcgttgtgcgagtatagtatttttattttgtttttttttagtttgttcggttttagtattatttgcgttatgagtgtcgagcgttatttggttattaattatgtttatttttatagttattacgtggataagcgattggcgggttttacgttttttgtagtttatgcgtttaacgtgtttttttgcgcgttgtttaatatgggtttcggtagttcgcggttgtagtatttagatatttggtgttttatcgattggattattaacgtgacggcgtacgtcgtttatttttatatgtacgcgggttttagttttttttttattttcgttatcgttttttgtaacgtgtttgtgtgcggcgcgttgtttcgtatgtatcgttagtttatgcgtcgtatttcgttgggtatcgagtagtattacgcggtcgcggtcgtttcggttgtttttcggggttatttcgttgtttttttagttttgtcgcgttttagcgattttcggcgtcgtcggagttttcgtcgtatcgcgggcgtcgagatttagatggttattttatttattgttatttttttggtggtgtttatttgttttatttcgttcgtggtgagtgatcggggttggggttttattcggtttttttttcgtatttatttttcgcgtttatttttcgttttttgttttttttttgagtttttggtagtgaacgtgtcgtttttaggtcggggttgggatttttatattgttttttagagtaggtttaattttttttgaagttttaattttaacgagatttagtaggtgttttgtttttatattttttagtttatgttttcggaagtttgggtttttttttttatcgagatagtttttattttttgttgtttgatattggtcgagttttttaagaaaatttttcgttttttttgttagacgtggaggggagtttgttgtagtgtgatttagtttattttttcgtattgtgaattgtgaattgta

SEQ ID NO: 181 - DNA, 2251 bp, Artificial Sequence
  chemically treated genomic DNA (Homo sapiens)
tgtagtttatagtttatagtacggaggaatgggttaagttatattatagtaggtttttttttacgtttaatagagggggcggggggtttttttggaagattcggttagtgttaggtagtaaggggtaagggttgtttcggtggagaaagaaatttaggttttcgggaatataaattgggggatgtaggggtaaagtatttgttaaatttcgttagggttgggattttaaagagggttgggtttgttttgagaaatagtgtgggaattttagtttcgatttaaaggcgatacgtttattgttaaggatttagagggaaagtagggagcggggaatggacgcgggaggtggatgcgagaaaaaggtcgagtagggttttagtttcggttatttattacgagcgggatggagtagatgagtattattagggaggtggtaatgagtaagatgattatttggatttcggcgttcgcgatgcggcggaagtttcggcggcgtcgaaagtcgttgaggcgcggtaaggttggggaggtagcggggtggtttcgggaggtaatcgaggcggtcgcggtcgcgtggtgttgttcggtgtttagcgaggtgcggcgtatgaattggcggtgtatgcggagtagcgcgtcgtatataagtacgttgtagaggacggtggcgagaatgaggaaggagttgaagttcgcgtatatgtaggagtaggcggcgtgcgtcgttacgttggtggtttagtcgatgaagtattaggtgtttgggtattgtagtcgcgagttatcgagatttatgttgggtagcgcgtaaaagagtacgttggacgtatagattgtaaagagcgtgaggttcgttaatcgtttgtttacgtagtggttgtagaaataggtatggttgatggttaggtagcgttcgatatttatggcgtagatgatgttgaggtcggataggttgaagaagagtagaatgaaggtgttgtattcgtatagcggttggttttcgggttattggttttttatgtacgtggcgatggttatcgggtttattaataaagtgtttaataggtcggtgatagttagtttatatattagcgtgtagaaggtcgtttttttttgttttttgcgcgatttgtatagtattacgatggttattaggttgtttattatttcgaagatgaatattatcgtcgggatggttattgggttgtttagtcggtcggggtttaaggaggcggacgaattgatttcgggagtggatatgatagtggttggcggtgcgtagttttggagtgtaaggttgggtttggggatggtagaagagagataaagttgtcgtgagcggaaattattatttgtaaggtgttagattcgcgttcgagaaacgatatattgataagataaggggagtaattcgattttattttttggattgtagttatttattaattgcggttattaaaatttttaggttcgcgatacgttttgttaatagtatatttttgttgatattaatatttataaattgatttttttatttttttttttttttataatttaatttattttattgttaagatgaataagatttattttaagggaaaagtagttcgttagtgttattttcgatagattttgaattaataaaatgtttattgaaaataagttataaaagtaatttggagagcgcgtttttttttttttggtttttttcggcgagggtcgtatttttgcgttttttattcgttgattttaacgttagtttaacgttattttatttgtagcggtagtagcggtggtagttttacgagtttttagggttagtttttagatgttttggattcgtttttaatttgtttttattttgttttgtttagtttggaaattgttaaattttcggttttttaaagtcggttttagtggttgtcgatttttggatatcgaggttagagttgttagtttttaaaaatttgggaaataagaggtgtagcgggatgggttagtgaagaatggtgttggattttttattcgttatttttttttttttaaagacgagttttagttttgtagtgttcgtcggtttcgtttgcgggaggatagcgtttaggtgtgaggttgtgcgcgtaggtggcgcggagttttggtttttagttttggttgtttttcgttttagttacgggtagtacgggcggttattggagtttgcggttgtcgttgaggtcgtttttggttatttgggggcggttcggggttt

SEQ ID NO: 182 - DNA, 2297 bp, Artificial Sequence
  chemically treated genomic DNA (Homo sapiens)
agaaaaatattatcgtgttttttcgtttgtatttaatatatttaaggttttttatttatttttttggaataaatttttagtaaatatttatttatcgatttgggagcgatggatttttataaaggtttgatcgttttttaagtggtcgaagtgatttgttttcgtggtttttttagtattgaagggggtgggggaagcggatttgagggggtgtatgtttttgtcgtcggtgggtttattttttaaaaattattgagatgcgttagggtggtcgtgattaagcgggtttagggttaattgtgtgagggggaagcgttttttagagcgcgcgtagcgtcgggggtttagtttacgtcgttgcgcgtttttgtgcgtatcgggtgaggatgtcgagttttgcgggtatttcggaagtcgcggtggaggtaggggtttcgttcggcgtagtgggtttgttggggaggtgtaggggaggttttgatttttggtttatttttttttagattttttcgttcgttttcggatttttagggtttttttttaaatttttttttgttttttttacgggaggtttttgtagtttttgggttttagggtttcgtaagtttcgggatcgatttgtgttcggggtgggtgtggcggaagtttgaatcggattatttaggtacgttatttgtagacgtagtgggcgagggggattttgttatttttttagttttttttttggatttcgtagcgaggggaattaaattttttttatgatagtttttttggcgttagtttggatcgagtggttataggttggattagggtaggtagaagatgtatttggtattttatcgaacggtatttgaattcgtttttattatttattaatggcgtgattttaggtaatttatttaaatttttcgaattttagcggtttttatttataatatgggggttaatgataatgtttttttcgtatgtaggtggattaaatggatataaagcgtttattttcgttcggtacgtttaaaatttttattaataggttagttaattttattacgagaggaattttttttttttcgttttttagagtgtgggcggtatgaggttacggaagtagttgttgtaattagtattttaaaatttagagattttttaatggtggtagggggtgaaagggtaggggggaggtagggttgggataggtagaggtaggtttttggggatttttagttttggggattaagcgtttggaattagttgggtttgggtagaaataagaaggtaaatgacgggatcgtcgtcggagttcggatttttatttttggagtttattgttttttttagggaatagaggagtgttttggttttttagtaatgaattaggagagtgtgagaaagagtatttgttttttttttcgtggttcgataagttatttttcggtagttttgcgagtagattaattgaaacgggtttggaattttatttttttttttcgatggagttgttggaggtttgcggatattgtttggttagttttcgggattatagcgtcgtgggttttttttcgtggtgtttgttttaaatttgggtgttattaatttatttaataatgacggatgattttgttataacgacgttagttaaaatattttcggtttaatttttttttaattaatatcgaagtattttgaatgagattcggatgaagtttgaatagtacgttttttaggtttagaaaatttgagtggtgggaagagaaaaagaaataagtagaaattaggaaagaatggttattaattgtttagattggtaagtgttaaataagttaggttgtttggaaaaagataaatgtcgttttttttttttacggtatggttagaatttcggcgatgggaaagtattttttgagtcggttaattttatatattttgtttgtgttttttattatttattatcgaaaatgttaggaagagttggggggtaagtgtttttttcgtgggtgcgagattgtatcgaagggttgttttggtataaagtttggggagaggatatggtggaggtggggttgtatttttattttgtttttttaatattaggttttgggtagagaaatttatgcgtgattttttgcggtagtcgtaggtagttgatcgtaaatagtttcgttcgtgtttcggagtagttgtgttattagacgtaatattggatatttgttttcgggttttaagaaggagagggaaagagttttttagaagataattcgagaaggggttagtagagcgttgggtggagtgtagatttt

SEQ ID NO: 183 - DNA, 2297 bp, Artificial Sequence
  chemically treated genomic DNA (Homo sapiens)
ggagtttgtattttatttagcgttttgttgattttttttcgggttgttttttggagggtttttttttttttttttttggggttcggagataagtatttagtgttacgtttggtggtataattgtttcgggatacgggcgaggttgtttgcggttagttgtttgcggttgtcgtaggaggttacgtataggtttttttatttaaaatttggtgttagaggggtagggtgggagtgtagttttatttttattatgttttttttttagattttgtgttagggtagtttttcgatgtagtttcgtatttacgaaggaggtatttgttttttagttttttttggtattttcggtagtagatggtagagggtataggtagggtgtgtgaaattgatcgatttaggaggtatttttttatcgtcggggttttggttatatcgtaaagagaagaaacggtatttatttttttttaaataatttaatttatttagtatttgttaatttgagtaattaatagttatttttttttgatttttgtttgtttttttttttttttttattatttaagttttttgaatttgggaaacgtgttgtttagattttattcgggttttatttaggatgtttcgatgttggttggaagagagttagatcgaaaatgttttgattggcgtcgttatgataaggttattcgttattgttggatagattgatagtatttaagtttaaggtagatattacgagggaaagtttacggcgttgtggtttcggaggttaattaggtagtgttcgtagatttttagtaattttatcgggaggagaggatgaagttttaggttcgttttaattaatttgttcgtagaattgtcgaagagtggtttgtcgggttacgggagaagaaataaatgtttttttttatatttttttggtttattgttgagaaattaggatatttttttgttttttgggagagatagtgaattttagggatggaagttcggatttcggcggcggtttcgttatttgtttttttgtttttgtttaaatttagttagttttaagcgtttggtttttaagattggaagtttttaagaatttatttttatttgttttaattttgttttttttttatttttttattttttgttattattagaaagtttttggattttgaaatgttagttgtagtagttgttttcgtggttttatgtcgtttatattttgggaagcggaggagggagggtttttttcgtaataagattagttgatttgttaatgagagttttggacgtgtcgggcgggggtaggcgttttatgtttatttaatttatttatatgcggagaaggtattattattaatttttatattgtagatggggatcgttgaggttcggaaagtttagatgggttgtttaaggttacgttattaatgagtaatggagacggatttaaatatcgttcggtaaggtgttaagtgtattttttgtttattttagtttaatttgtagttattcggtttagattgacgttagaggggttattatgggagagatttggtttttttcgttgcggggtttagggaagaagttgagaaggtagtaaagtttttttcgtttattacgtttataggtggcgtatttgggtaattcgatttaagttttcgttatatttatttcgggtataagtcgatttcgaggtttacgggattttaaggtttagaggttataggaatttttcgtgaagggggtaggagaaagtttgagggagagttttgaaggttcgggagcgaacgaaaaagtttggaagggaatagattaggagttaggattttttttgtatttttttagtaggtttattgcgtcgagcggggtttttgtttttatcgcggttttcgggatgttcgtagagttcggtatttttattcggtgcgtataagggcgcgtagcggcgtaagttggattttcgacgttgcgcgcgttttgaggggcgttttttttttatatagttgattttgggttcgtttggttacggttattttggcgtattttaatagtttttagaaagtgagtttatcgacggtaaggatatgtatttttttaaattcgttttttttattttttttaatattgagaagattacggaaataaattatttcgattatttagaaagcgattaaatttttataaaaatttatcgtttttaaatcgatgggtgaatatttgttgggaatttgttttagaggaataaatgaggagttttgagtgtattaaatgtaaacggggggatacggtggtgttttttt

SEQ ID NO: 184 - DNA, 2590 bp, Artificial Sequence
  chemically treated genomic DNA (Homo sapiens)
gcgttgagtaggcgcggttacggtgtttagatttttcgggggtattttagttttcgttatttagtggtttacggttgcgggttttagggtttgaggttggggattatcgttgtcgtcgtagtttttatatttcgaagttgttttgttgtttgtgttgttttcgtagatagtatttttggcgttttgtgcgtttttttttttttttttttttttttattcgtttttattgttttgagtttttgaaagttgggagaatcggagatatttttgaggattggtaatgaagttttatttaagtgggatgtaattttcgtttttttatttttttttaagaaggaggttgtgtttttattttgttttgttttgggtgttgatttttaaaaaattagagtaaaatgaacgtgaataaaaagaaaaggagaaatgtttcgagttggggtagagggagtagagaaggagtttttatcgcggtcggaatgtagagcggattttggtttaggattgggtttttttttaggttcgggtttattttggttttcgttgttggaatttttaggaggtaaagcgatttcgatttttgttgttcgtattttcgggcgtgagtgttttttttaggaggtttaggaggtcgtttttgttgtattttgagttttcgttgtaaaaattgaagttcgtgggtttcggtaggttttttagttcgttcgtttcgggataggttttcgtttatatttttggaagtaaggagtttcgggttttttcgtttttttcggggtgtggagtttttggggtttttgaaaggtgaggttttagaggcgagggaggggtgagcggggagttttgttcgtttgcggttgcgttttcgttgtggattaggaggtaggttaatttttcggattttgggggaaaaattatagcgggttttttgcggaaattttggtcgttttaatttgttaagagtttgagtgaggttttggaagtttttagtttcggtttaggtcgggacgcggttgttgagtttttttaggttcgtaggatagcggttttcgtcggtggcgtcgttgtatttaggttttttttagatcggtggcggtagttaattcgagatttgcgtttttcgggttcggggtagttaggaggtcggcgcgtagcgggtcgggttaggattgggtcgagtagatagagttgtagttttcgttttgttcggtttttcgcggttggagagtagagcgatgttattcggagtttcgtttgggtggtaacgagattttggttagttatttttgtagtttagattaattttttttaatagtttttgatggtaattatagtaatcgaagttgttatatatttttaggtaattatgatatataaaaagtttcgaggggattttttggcgagggaagttaagaacggttttttagttttaggaaatttcggttcgttttacgtcggagttcgttcggtttgttaaatgagaggagttttgtaacggggttaattagtttgtttcgtgattttaagttattttaacgtggttgggtggcggagtttgaggtataggttcgttatgtttcggaattttcgcgttttttttttttgggtttcgttttagttcggttgtttgtttttaatttgtttcgggagtcgcggtttagaggtttgtttagaggtaggattcgtattggtggtggtttagagggtaatagttcggaagttcgggcgggggaattcgaggaggggtttttattttgtattggttttttttttatttttatcgggttttttagagatgttgttatgggttttttgttcggatgggaagtggggaaaaagagattttattattgttttttttatttatttattttggtatttttaatagtgttatagggaagaggatagttggggtgatagtattgttgggttttaaacgtggattttggagcggttagagggcgcgtgttaagtagaggatggttgtaagatatggaaattaagtttatcgtttttagagtgagtgtagtgtagcggagttttagattcggtttttgagcgattaggaatttttttgggcgtagtgataggttcgaaggagtggaggataagattcgttgtgtttttgtttggttttttttagttttttttttttatagtataattttttttttcgttttgtgggaggggggcgtcgagtcggtggtcgtcgcgtcgcgcgttttttttgttcgtttttgtcgtcgttcgaatttttatgttattttttttgacgggttattggtggttttataggtaggtgttgtcgcggggttgtaattattcggtcgagtttggtcgttatcgaatatttttttatttttaagtacggtttttcgcgtttttttttttttattttttttatttgagacgagtttgggatttacggtgtaagttcgttcggacgtttcgggttttaggagtaagtttatatttgcggtgtttcgaggtttttttcgcgttacgtttttattttttttatttttttcgtttagacgttttattgtcgtttttttttattttaattttatcgtagtttttaatttaagcgttttcg

SEQ ID NO: 185 - DNA, 2590 bp, Artificial Sequence
  chemically treated genomic DNA (Homo sapiens)
cgaaagcgtttgggttggggattacgatgggattgaggtgggaaggggcggtagtggaacgtttgggcgaggggagtaggggaggtgagggcgtggcgcggggagggtttcgaggtatcgtaggtgtaaatttgtttttggaattcgaggcgttcgggcgagtttgtatcgtgggttttagattcgttttaggtggagggggtgggggaaggagagcgcgggggatcgtgtttgggggtgagggggtgttcggtaacgattaggttcggtcgggtaattataatttcgcggtagtatttgtttatagagttattagtgattcgttaaaaagagtagtatgggaattcggacggcgataaaggcgggtaggggaggcgcgcggcgcggcggttatcggttcggcgttttttttttatagggcgggaggggagattgtgttgtgggagggaggggttggagagggttaggtaagggtatagcgggttttgttttttattttttcgggtttgttattgcgtttaagggagtttttggtcgtttaggaatcgggtttggagtttcgttgtattgtatttattttggaagcggtaaatttggtttttatattttataattattttttgtttaatacgcgttttttgatcgttttagggtttacgtttggggtttagtagtattgttattttagttgtttttttttttgtggtattgttgaagatgttaagatgagtgagtgggaggagtagtggtggggtttttttttttttattttttattcggataggaggtttatgataatatttttggagaattcgatgagggtggagggaagattagtgtagggtgggggttttttttcggattttttcgttcgagttttcggattgttgttttttaggttattattagtgcgagttttgtttttgagtagatttttgagtcgcggttttcggggtagattagaaataggtaatcgggttggggcggggtttaggagggagggacgcgaaaatttcggggtatagcgggtttgtgttttagatttcgttatttagttacgttaaggtgatttggggttacgagataagttggttgatttcgttgtaaagttttttttatttagtaagtcgagcgagtttcgacgtgaggcgagtcggagttttttgaagttggaaaatcgtttttaatttttttcgttagggggttttttcggggttttttgtgtgttataattgtttaaagatatatggtagtttcgattattgtaattattattagaggttgttgaaagaagttagtttgggttgtaggggtgattggttagggtttcgttattatttaggcggggtttcgggtgatatcgttttgttttttagtcgcgagaagtcgggtaaggcgggggttgtagttttgtttgttcgatttagttttgattcggttcgttgcgcgtcgattttttagttgtttcgggttcgagggacgtaagtttcgggttggttgtcgttatcggtttggaaagggtttaaatgtagcggcgttatcggcgggggtcgttgttttgcgggtttgagaaagtttagtagtcgcgtttcgatttgagtcggggttggaggtttttaaggttttatttaggtttttggtaagttagaacggttaaagttttcgtaaggagttcgttgtggttttttttttaaagttcggagggttggtttgttttttagtttatagcgggggcgtagtcgtaggcgggtagagtttttcgtttatttttttttcgtttttgaggttttattttttaagggttttaggggttttatatttcgaaaaggacgaaagagttcggggttttttatttttaggggtgtaggcgagggtttgtttcggggcgagcgagttaggaggtttgtcgagatttacgggttttagtttttgtaacggaggtttagaatgtaatagaaacggttttttgagttttttgggaaggatatttacgttcgggaatgcgggtaataaaaatcgaggtcgttttattttttggagattttaatagcgagggttagggtaggttcgagtttaaagggaaatttagttttgggttagggttcgttttgtatttcggtcgcggtgagggttttttttttgttttttttgttttagttcgaaatatttttttttttttttttgtttacgtttattttgttttaattttttaaaggttagtatttaaagtaaaataaaatgaaaatataattttttttttggaggggggtaggagggcgggaattgtattttatttaagtgagattttattattagtttttagaagtattttcgatttttttaatttttaaagatttaggataatgagggcgagtgaaagggggagggggagggaaggaacgtatagagcgttaaaaatgttatttgcgaaaataatataagtagtaaggtaatttcgggatatggggattgcggcggtaacggtagtttttagttttagattttggagttcgtagtcgtgggttattggatggcgggaattgaaatgttttcgggagatttgagtatcgtgatcgcgtttgtttaacgt

SEQ ID NO: 186 - DNA, 4133 bp, Artificial Sequence
  chemically treated genomic DNA (Homo sapiens)
aggattaaaaatttttttttttaaaaagattttagaagttttttttttagagaagatagaaaatattgataaattgtatattgtgtagatgtttagttttgaaatgtagttttgtagttttttattttgtagtttattggttgtatttgtatttttgggtagtgtttttgtagggtgtaaatatttagagatttagggatttggtagttttgtgtaggttttttgtgtgtattgtttagtgagtgggttttttgtagatggtgggatgttttaggagattgtgaggttggtgtagtttggtgagtttttggagggaaggtggtgtgttagaaaggattggattttagtaatggttttggattggttttgtgtggttgttttttttttttgttttgttgttgggatttttttagttagtgttgaattttttaattgggaaggattgagttattttattttttgggaagttgtgtgtttatttgtttttggtagtgttggagtttgagttggggattgggtggatatttatagagtttgtattgtagtgtgttgtatgtttttgtttttgtttgttggtttgtgttttagtgaattaattgtaaagttggtttgaagtggtgatggtgtttttgtggagtttatttgttgttttagtgtgtttttgagtagggattgggtttgttggggtttttgttgggtttgtgtgtttgtatggtatttgttgtatgagttgtttttgtgttttttttttgtgtttggttgtttagtttggtgttggtgttttatgttttttgagtgtaggagatttttttgttttggttttgtttgttggtgttggtgtttattttttgggtgtggaaatttgagtttattttttttggttgttggttttgggattgtgggtttggttatgtagttttgtttggatttaaagagttttagtttttgtgaatattaggtttgtgttgggagatgagaaggtgtttagtggggtttagtgtggttttgaggggtagggtgaggtttgtgatgttgaggttagttatggttagttataggtgttgtgtaaggaattggggaaagttttttgttaagaaagggaaatgttagtttagttaaaaaaaaaaaaaaaaaaaaaaggttggggtttaatgagaaagttttttagaggtatttttttagtttttttatagttttttgggagtttttgaatttgtatttgaatggtgtggttttgggtttgtgaaggtttggtgggttgaagttgttttttaggtttttaaaggaatgtagttaggttggaatttatttttttttttaatttttagaaaatggaaatgttttttttgtgatttttttttgttgagttagattttaggttttttttgttgtgggtgtttggttttttttgttgatattttggatgtttaggtttgtgggataaaaggtagttgtggtgttttgtgggttttttagtttgggagttggttttaggggttttaaagtgtgattttaggttgataattgtaagtttttaggtagaggggaagttttagtgttgagaagtttgttttgagaattttttgtgttgggtgtttagtttgagtgttttgggtgtggagtttatttttggtgtgggtagggttttagttgtaggtttggtgtagggtggatttggttgaagtttggagggttggaggtgttgggatgtagtttggataagagggtggatttgattttggaaagtttgtgggatttaggtattttaatattgggaagataaagagatttgatttttttgggattggtgaggggagtttggtggggaggggaatggtagggtagttaagtgtgaaagagaattttttgggtttaaagttaatgtagttattttataagttattttagaggtgattggaaaaaataataataataaaggtgtttagtaggttgtggttgggaaggaaaaataatgtttgtaagatgagtgtgttgatttgtagttttatattttttgtttattagttggaatatatatagatttatatatttagtaaatgtaaattttattatttaaagatgtgtttgttttggttataattgttttaagtgtttataggttaattttatatatggaatattttgaaagtgggtgatttgatttttaagtttaattggtttgtgttgtttgttgaattgtaaattttagtaaaatttaaatatattggaattttagttgttttttgggagtgaggaagtgggagtaatgttaaaaggggaaaagaagaatagtaaaaaaagtataaagatattattttttgatgtaaaattatgggattttttttaaatggtataagagaatttttggagaagattattattaattaataagtaataatgttttttagggtttattagatgttttatatttgtttgggaattttgattttttaggttttttgagaaatttatttgtttggaagaagttgtattttgttgttataggagttgttgagagttagggatggagattttagatttaggattttgttatgattttattgatttttaagtgttaatagaatgaaatggatatgtttattagttattataaattgaattattttatatgagagagagaaatgtggtttaagttttatatttgttttttaaataattgattttttttaattttgtttttaaaggtttgtggaaattagggagggggttggggagatggttttagaaataaaatgtttttttttagtatggtttttatatttagtttatttaagttgatttttgtaatttatataaagaatgggtttgggtgggtggttagtgaagattggggtgagtaagtgtttatgttgttgagtgttggggaggtttaggtttgtttttgtatagaattttgtaaggagtgtgttttgttaggtgtttggattagagggtgttgtgtttttgtaaattttgtggttttgatgtgttttttttaggtattattgttataataagttatatttaaaataatgtataaatagtattgttttttaagttttttttaatagtgttttatatgtattttatgaatttttaaagttatgtatatgaattttttattgttgatttgtataaagttagagggatgtgtagtttttggagttgagaatttgtagggtgtatatgtttttttgtatttgtttagagttatatattttatgtaattttattaatgtttaaatttaaatgttaaaaggtatgtatgatttgaataaagaatttattagtttagttgagtttttggttttgggttttaaagtttttggtagttttgtgatttttttgtggtgtagatatgtgttaagagttgggtttgaagtattaattttgtttttttgggatttttagtatgtttttaattagagtgttaatgtttgtgttgttgggatttaggtggttgtatttttggaggtttttgattagggtaaatttaagtattaaatgtaggtgaaaagagagtgtgtggggttggaatgagggtttgggagtagttaagtttgttaggatgtgtttaggtagttagttgttgagttgaggagttgtggttgttggttgtggtgatttgttgtttttttttttatttttttttttttggaggtggtgggggaggggaggtgatgttagtgttttgttttgttttttgttttgggtgtggatgggattttttggttgggtgtgttattttgatagtggtagtagtggttgtggaggttgtgggggttttggtttttgtggtttttttggttggttgtagttgtggtgtgggtgaaatgtttgttttttttttttggttgtgttttttgggtgttggtgagtgtgggtgttttttgtatttagtgtttggagttgtttggagttttgttgtgtgtatttttttggtttgtggagtttttttggtggtgttttttatgttgtggattgtaggtgatgtttttttttttttgtagttgaaatttgttgtgatgtgttgtttgttagatttttgttgggtggaagtatgaatagtttttgtagattggtttggatgatttgtattttgtggttttttaatttttggatgtgaatttttt

SEQ ID NO: 187 - DNA, 4133 bp, Artificial Sequence
  chemically treated genomic DNA (Homo sapiens)
aaaaaatttatatttagaagttggagggttataaagtataagttgtttaggttagtttgtagagattgtttatgtttttgtttagtaaaaatttggtaggtgatatattgtgatgaattttggttgtagaagaggaagagtattatttgtagtttgtggtgtgggaaatgttgttggaggggttttgtgagttggggaagtgtgtgtagtggggttttaggtggttttaggtgttgagtgtgaggaatgtttgtgtttgttggtgtttgggagatgtagttgaaggaggagggtgggtgttttatttgtgttatagttgtggttggttagagagattgtagaggttgggatttttgtagtttttatggttgttgttgttattgttggggtggtgtgtttagttggagaattttgtttgtgtttggggtggggggtgaggtggggtgttgatgttatttttttttttttattgtttttaagggggagggagtggggaaagaggtagtgagttgttgtagttggtggttgtaattttttaatttggtggttggttgtttgggtatgttttgataaatttggttgtttttgggtttttgttttggttttgtgtattttttttttgtttgtgtttggtgtttaagtttgttttggttggaagtttttggagatgtggttgtttgggttttggtggtatggatgttggtattttggttagggatatgttgaagattttggggaggtaaagttggtattttaaatttggtttttaatatatatttatattgtgaggggattatggagttgttgaggattttagagtttagggttgaggatttggttagattggtgagttttttgtttaaattgtgtatgttttttggtatttaagtttaaatgttaatgaaattatgtggggtgtgtggttttaagtgagtgtggggaagtgtgtgtgttttatgggtttttggttttaggagttgtgtatttttttggttttgtgtggattggtgatgaaagatttgtatgtatagttttgggagtttataaaatatatatagagtattgttaaaaagaatttgagaggtgatgttgtttgtgtattattttgaatgtaatttattatagtaatggtgtttagggagggtgtattggggttgtgagatttgtaggggtgtagtgttttttagtttgggtatttggtgaggtgtgttttttgtagggttttgtgtggaggtgaatttggatttttttggtgtttggtgatgtgggtgtttgtttattttagtttttattgattatttatttgggtttattttttatatgagttataaaaattagtttgggtggattggatgtagaggttgtgttggaggaaagtgttttgtttttggaattgtttttttaattttttttttaatttttatgagtttttggggatagggttagggagggttgattatttaaaggataaatgtggaatttgaattatattttttttttttatataaaataatttgatttgtggtagttaataggtatgtttattttgttttgttggtgtttaaggattagtagaattgtggtagagttttaagtttgaaatttttatttttggtttttggtggtttttgtggtgatgaagtgtaattttttttaggtagatagattttttagggagtttggaaaattgggatttttagatagatgtaaaatatttagtaagttttaggaagtgttattatttattaattaatggtaattttttttaggaatttttttgtgttatttaaaaaaaattttgtgattttatgttagggaatggtatttttgtattttttttattgttttttttttttttttttagtattatttttgtttttttgtttttaggaaatggttggagttttggtgtgtttgggttttgttgagatttataatttggtaagtggtataagttggttgggtttggagattaggttatttatttttgaggtgttttatgtatgaaattgatttgtaagtatttggagtaattatggttgggataaatatgtttttggatgatggagtttgtatttgttggatgtgtgaatttatgtgtattttaattggtgggtagggaatatagggttatgaattggtatatttattttgtaggtattattttttttttttagttataatttgttagatatttttattattattattttttttggttatttttaagatggtttataaggtgattgtgttaattttgaatttaggaaatttttttttatatttgattgttttgttgtttttttttttgttaagttttttttattagttttagggaaattggatttttttgtttttttagtgttaaaatgtttgagttttataaattttttgagattaagtttgtttttttgtttgggttgtgttttagtgtttttggttttttgggttttggttgagtttgttttgtgttgagtttgtggttggagttttgtttgtattggggatgggttttgtgtttgggatgtttaggttgggtgtttggtgtggggagtttttggagtgggttttttggtgttggggttttttttttgtttaggaatttgtagttgttggtttggggttatgttttggggtttttggggttgatttttgggttaggaagtttgtgggatgttgtgattgttttttgttttataggtttgggtgtttggggtgttagtgggggaggttaggtgtttgtggtggggagggtttggggtttaatttggtagaaaaaggttgtgggggaagtgtttttattttttggggattgaaggaggaagtagattttgatttagttgtatttttttggagatttgaaggatgattttagtttattaaatttttgtggatttagagttgtgttatttaaatgtagatttaggggtttttagaaggttatggaaaagttaaagggatgtttttgggaagtttttttattaggttttagttttttttttttttttttttttttagttaagttaatgttttttttttttggtagggagttttttttaattttttgtatagtgtttgtggttggttgtaattaattttggtattataagttttgttttgttttttggagttgtgttagattttgttgggtgtttttttgttttttagtatggatttggtgtttgtagggattggggttttttgggtttgggtgggattgtgtggttgagtttgtggttttagagttggtagttggggaaagtgggtttgagtttttgtgtttgagaaatgagtgttggtgttggtgggtggggttggggtggagggattttttgtgtttggggagtgtgaggtgttggtgttgagttgggtggttgggtgtggggagagggtgtgggagtggtttgtgtggtaggtattatgtggatgtgtgagtttggtgagggttttggtaggtttggtttttgtttgggggtgtgttgagatggtgggtgagttttatgagagtgttgttgttattttgggttaattttgtggttagtttgttggggtgtgggttggtgggtgggggtgagagtgtgtagtgtgttgtggtgtggattttgtgggtgtttgtttggtttttggtttgggttttggtgttgttgaaaatggatgagtgtgtgattttttggagggtggagtgatttggttttttttagttgggaaatttagtattggttaggggggttttggtggtggagtgggaaaaggaggtgattgtgtgggattgatttggggttattgttggggtttgattttttttgatatgttgttttttttttgggagtttgttgggttgtgttggttttgtggttttttggggtattttgttgtttgtgaaagatttgtttgttgagtggtgtatgtgggaggtttgtgtggggttgttgggtttttgggtttttgggtgtttgtgttttgtaggagtgttgtttggaggtgtagatgtaattggtggattgtggagtgaagggttgtgaggttgtattttggggttgaatatttgtataatgtgtggtttgttagtgttttttgttttttttggaggaggaatttttaagatttttttaaaagaaagagtttttggtttt

SEQ ID NO: 188 - DNA, 4318 bp, Artificial Sequence
  chemically treated genomic DNA (Homo sapiens)
tatatagtttattagtgatagagtaagatgagatttgaatttatgttattgatttttagtatagtttatatttttggttttatagatgaagaaattggttttaggagggataaatgatttgtttattttatttaataattgtgtattaaatttatttttataagtgtgttagtaggattagttttgagtaaaaatgaaagtttagtaaagtttaatttttagtatattttatgtttttatgattatttttatttgtaattgatatatatttttggtattttgttttttagttattttagattatgtaattttggtttggagatttggttttatttattgtttttttatttttagtaatttaagaggtataaaaaaaatttatttttaaatggttatatattgggtagggtaggggtaaagagaagtgattggtttttggttggaagaaggtggtttattatttagtttttggttattgtttttttttagatttagtgtagatatttttaggttggtttttttatttttttttattgaggttaattattttgttttattgtagggttttaggtttttttatttaaggtttgttttgtttttttagttttttttttagtagttttaagggtttagtttgtgtttgattatttaggattattagattttaaagttgtggaattttataatttttatgagtatatgtttttttttagggtttttttatgtttgaaaaggtggttagtagttttttgttatttttttatagtagtagtgtaggttagttgataaggattataaatttttagtgttttatagttggtgtttagatagtgtgggtgatgggtagaataagagtttttgaagtaagtttagaaattttaataagttgaaatgtagtagagattgtagaggtataaggaaagggattagatatttaaattttgtaggggtttaggaggttatgttttaaagtttttttgatttttgttttttagttttttttagtggttattaagtgtaaagttttatgtttggtttttaagttatttaagtagttttttttagagatttgttgtgtgttagatattttgttagaatttgggaattttaggaatgaaaggaatataagtagaaaaaaattagaagaatataaagagtttgtattatttaatttttaagatattttttttttttttgggtgttagtatttagagagtattgattttagtgttaaaatttggttttttttgaggtagattaggagttattatgtttttagtgaaatggaggtggtaggaattttatttttaatttttttttttttttttatgattatttttttgggggtgagagttgtttggaagaattatttgtgttttggtattggttttttgttgagttttagttggataaaattagttgattgtttatattaataagtgttagagtttgtgtttagttgagtgggtggggagagtagtattgggttgggttgtatttttgtttgggtttgttagagtagtggatagatagtatttgttgtgggtttttttgtttttttatttttgttagagtttgtggtttttttgtggagattggggattatatttgggagtatttttttttaatttttgttattgtagagattgtgttgagtttatttgttaaatgttaatatattggaatgttaggggaggggaaaagaaggttgtatttttattttttttttttattatatatttattttttattgattttgttatgattgggttttggtatttgggtttgggggtgttaattgatattattttttgttaggtttttatgtttattttatattttgggattgtttgggggtggatttggttttggtggttgtttttggttttgttgttggtttttggttattttgggtggggatgtggagagtggggttggttttttttttgttgtgggtttttatttatttttttatttgggaggggtaataatttgggagttgtgttatggaaatgtatttttttttgttatttagatgggaatttgtttatttatgataattgttttttttgtttagggaaagggggtgggaagatttagttttgggttttgttaattgttagtaagttagatggatagatagtagttgttgtgtgtttgagtttagtttttttttgattttttgttttttatttttttgtttgttttattgatattaggggttgtagtggtgatggtgttttatttttagtgtttggtttggagtttttgaggtgatttgggttgggtttgttgaggattttttataattggtggttttttatttttttttgattggttttgtttttagtgttttaagagtgggattaggtggttgttagtgaaagatttataggagtttagatttgaggtttgttaggatgtggagattgagggtgggtttggttgttaggaagtgtttttgtttggggtagtaatttttttttgtttttttttgtaatttttaatttgggagggttttatggggtttttttttttatatagtgggttagtttagtggggttgttttttgttaaagatttggtttattttttaagtgtttttttttttagtttttataaaaatttttttagaattttggggaattaattatgttggtgggagtttttagtttaggtttatttttttattttatagtttttgattatataggggagtatgtgggattttttaggtttgagaatttttttttaagtttggatggagttttaagagtggtgagaaggattagattgatttgaagagttgttttttttagtttgttttttttttatatttttttattttagtttttattgatttgtttttttttgtgtttgtttagtggggggtgaaggagaggataattatttttatttttttttttaatttttatatatattttttgttttttaaggtggagttttttgggaggtgggtagttttgtagatttttttgttttaaggttttgtaaaggtagagtttttttttgttagtttggggttttttagttttttgttgtatttgttatttttttttatattttttttatttttttttgtagtatatttggatatagattattttttgattttgtaaaaaataaaataaaataaaataaaataaagttttgagaaatttttaaatatttgtgtgtggatgaattatagtttatagttgtttttatattttttattataattggttttttttttaattgtgggaggtaattgtttttaagttgggttatagttgggggaattgaggattggggggaattgaatgtgggttttgaatgtttttgtaaggttttttttattttattttatagaaagtagggaagtgagtaaattttttattttttttgattttagaaagtttgtttgttgtttttggagttagtatttgttttttttttgtttattttattttttaatgaaggtattatttgggagtggtattatagttttaagatggaggtatggagggtagtagaagttgagttatagtttttgtgtattttttggatttttttaaggagggtatgtggaagagaaagtttgtttttttttgggagtatgggttattgttttttaggttttttttttttttaatatggaggaaaaattttaaaataagtttgtgtgtgttttatttttttagttttttttttatgatttaataaaattattattattgagggttaatttttagggttttgtttgatgtttataggttataaaaggaagaattttttgggttggttatttggggatgggagggtgaggagtagtttatgggaggttttgtttttgtgagaaaggatttgtatgtttaagaggttaatatagttagtttagggtttttttttttttagatttttagttttgtattaggttatagagaggaaatggtaaagagtagtaaatattatgtaaaagggtaaaggagtttttaagttaggagttgggagtttttgggaaaagaaaagggaagaatatgtttaaatttttgtttatagttgggtgtggtggtttatgtttgaaattttagtattttgggaggttgaggtaggtagattatttgaggttgagagtttgagattagtttgattaataaggagaaattttatttttattaaaaatataaaaaataaattagttgggtgtggtggtatatgtttgtaatttaagttatttaggaagttgaggtaggagaattgtttgaatttgggaggtggaggttgtggtgagttgagattatattattgtattttag

SEQ ID NO: 189 - DNA, 4318 bp, Artificial Sequence
  chemically treated genomic DNA (Homo sapiens)
ttagagtgtaatggtgtgattttggtttattataatttttattttttaggtttaagtgatttttttgttttagttttttgagtagtttgaattataggtatgtgttattatgtttggttaatttattttttgtatttttagtagagatggggtttttttttgttggttaggttggttttgaatttttgattttaggtgatttgtttgttttggttttttaaagtgttgggattttaggtgtgagttattatgtttagttgtgggtaggggtttagatatgttttttttttttttttttttaggagtttttagtttttagtttgggagtttttttatttttttgtataatatttgttgttttttgttattttttttttgtagtttgatgtagggttggaagtttggaagagaggaagttttggattagttgtgttgattttttagatatgtaaatttttttttatgaaagtagagttttttatgagttgttttttatttttttgtttttaaataattagtttaaagaatttttttttttgtggtttgtgggtattaagtaaagttttggaaattagtttttagtgatgataattttattgaattatgagagaaggattgagggagtggagtatatgtaagtttattttggagttttttttttatgttaagggggagaggaatttagaagataatgatttatatttttagagaaaggtagatttttttttttatatgttttttttggggaagtttagggggtgtataaggattgtggtttggtttttgttgttttttatgtttttattttggggttgtagtgttatttttaaatagtgtttttattgggggatagagtggataagggaggagtaggtgttgattttaggagtagtaagtaggttttttgaagttagggaaaatgagagatttgtttatttttttattttttgtgaagtggggtggaaagggttttgtagaagtgtttaaaatttatatttagttttttttggtttttaatttttttaattataatttggtttaagagtagttgttttttatggttggggggagggttaattgtgatgagggatataggagtaattgtgaattgtaatttgtttatgtataggtgtttggagattttttaaggttttgttttgttttgttttgttttgttttttgtggggttgaggggtggtttatgtttagatatgttgtggggaaggatgaaaggagtgtgggaggaggtggtaaatgtggtagggagttggaagattttagattgataggaggaaattttgtttttgtaaggttttaaggtagaaggatttgtgaggttgtttgttttttaggagattttattttaagggatggagggtgtatgtgaaagttggggggagaagtgaaggtagttgtttttttttttattttttattaggtaagtgtagaaggaagtaggttggtggagattagggtagaggagtgtaggagaggagtaaattgaggagggtggttttttgagttaatttggttttttttattatttttgaggttttgtttaggtttggaggagggtttttaagtttaggaaattttgtgtgtttttttgtgtgattgggaattgtgagatgggggagtaggtttgagttgggagtttttattagtatggttgattttttggagttttgaaagagtttttatggagattgggggaaggggtgtttgaagggtgggttaagtttttggtagaaagtagttttattgggttgatttattgtgtggaggaggaggttttgtagggtttttttgggttggaggttgtagaggagggtggaggaggattgttgttttgggtgggagtgttttttggtggttgaatttgtttttagtttttgtattttggtgggttttgagtttgggtttttgtaggttttttgttagtagttgtttgattttgtttttgggatgttagggatgaggttggttgggagagaatagggggttgttgattgtaaaagatttttgataggtttagtttggattattttgagggttttggattgagtgttgggggtggggtgttgttgttgttatggtttttggtgttggtggagtgagtagggaggtagagggtgggggattgaggaggagttgagtttggatatgtagtagttgttgtttatttgtttggtttgttggtagttggtagggtttgaggttaggtttttttgttttttttttttaggtgggaagggtggttgttatgggtgggtggatttttgtttgaatagtaggggaagatgtatttttgtggtgtggtttttgggttattattttttttaaatggggaaatggatggagatttgtggtgggggaggagttaattttattttttgtgtttttgtttaaggtggttggaggttagtggtaggattaggagtgattgttagggttaaatttatttttaggtagttttagagtgtggagtgggtatggggatttggtgggaaatagtgttgattagtatttttaggtttggatgttagggtttagttgtggtgaggttagtgaagggtgggtgtgtggtgggaaaggagagtagaagtgtaatttttttttttttttttttggtattttagtgtattaatatttggtaggtgggtttggtgtggtttttgtggtgatgagagttggggaaagatgtttttaagtgtagtttttggtttttgtgggggggttataggttttggtaggagtgagggaatgaggaggtttatgataggtgttgtttgtttgttgttttgataggtttgggtgggaatgtggtttggtttagtattgttttttttatttatttagttggatgtggattttgatatttgttagtgtgagtaattgattaattttatttggttggggtttagtaggaaattaatgttgaggtgtgggtagtttttttgggtgatttttgtttttgggaggatagttgtggggagaggaagaggggttgggggtgggatttttgttgtttttattttattgggggtgtggtggtttttgatttgttttagagaggattgaattttggtgttaaggttggtattttttgggtattggtgtttagagaagaaaagggtattttggaagttaggtagtataaattttttgtgtttttttggtttttttttatttatgttttttttatttttgaagtttttggattttagtagagtgtttgatatgtagtaggtttttagaaaagattgtttaaatgatttgaaaattaggtatagaattttgtgtttggtgattgttagagagagttgaaaggtaggaattaaaggggttttgaagtatagttttttgaatttttgtaggatttgggtatttaatttttttttttgtgtttttgtagtttttgttgtattttagtttattagaatttttgaatttgttttaagggtttttattttatttgttatttatattatttaggtgttagttatgagatattagggatttgtaatttttgttagttggtttgtattgttattgtggagaagtggtagggagttgttggttgtttttttagatgtgaaaagattttagaggagagtatatgtttgtaaaaattatgggattttatagttttgaaatttaataattttgggtgattaaatatagattggatttttggggttgttggggaaggggttaggggagtggggtagattttaggtgggagagtttggggttttgtaatgggatagagtaattagttttagtgggaggagatgaggaagttagtttgagggtgtttatattgagtttgaggagaaataatagttaagagttgggtggtaaattatttttttttaattggaaattagttatttttttttgtttttgttttgtttagtatgtggttatttggagatggattttttttgtattttttgagttgttgggggtggagggatagtaggtgaaattaggtttttaagttaagattgtatggtttggagtgattgggagatagaatattaaaagtatgtgttagttgtgggtgagagtaattatgaagatatggggtatgttaaaagttaaattttgttaaatttttatttttgtttagagttggttttgttgatatatttatggaaatgggtttggtatatagttgttgaatgaagtgggtaagttatttattttttttagggttagtttttttatttgtaaaattaggggtgtaaattgtattggaagttaatgatatgagtttaagttttattttgttttgttattgatgaattgtgtg

SEQ ID NO: 190 - DNA, 3324 bp, Artificial Sequence
  chemically treated genomic DNA (Homo sapiens)
tttaattttaatttttttataggaataatgttaattagtgaggtttaatgagaattttttttaggaagtgtagtttggtaggggtggttggatttgggtaaatgtagttttgggtgggagtagggttatttttgtttttgagtggttggaataaaaatgtggattgtattttttttttttttttatttaaagtgtttagttttgaagataaggtggagggaggagagagagggtggaggtgtaaatttaatttaatttttgtgtgtgtttttgaggtggttggttgtttttgttttgttgtgtttttttattaaggaaggtttttttgttaggggttgttaatgtttgtggtttttggttagatggtgtatttgagagggatattttgtttttttttgggagggatttgggtttgttgaagtgggtttaattttgtaaattgtgttttaattttttgtgttgtgttggggaatttttttttgatatttaatgttttttgtttttatatttttaaatatagtttatttttttttttgtggtggttgtggtaatttgagtttggtttttgttttgttgttagagaatgttttttttgttgggatgtggtgttgagtttgttgtatattgagtggttgtggtataatattgtggtgttgtgtgtataattattgttttttaggatttgtggtgtgtattttgggagtggggtgtgttttgtgattttgggtgtttagggttagatatattttttgggtgttttgtggtttttatagtgtagtttttattgttttttttttatttttgggtatatttatttgttttttgttttagtttatttggtttagggtgtagttgtttttttgtgtttttttttttagttttggtaaaggaagttttttttgtgtttttttttttagaattgtttttagttttttgtttttttaattgtagtttaatggttggtggtagtagttggagaaggggggtggtggtttgggttttggaaatggtttgattgttgggatttgggttggattttgtatttgggttggaagtgaggtggagatgggtggttgggatttgtgagtgagtggggtgggtggtggtgatagttttatagttttagttgttgttgttgttgttgttgttgtggttgtttggggagaggggttggtattattgtggtgtgttattgtttggtttgggggtgggggtggttaggaggagggtttaggtgagtagtggtggtagtggtggtggtgttgtggtttggaggaagggggagggggtattgggtatggggaggtgggagagggggtgggattgggtatggggtgggggtgggggggaggggagtgtagggagggtgtaggtagggggagtaggaggagtagtaggaggaggtggtggaggggtgggtgagagggaggagtgggtatggggggaaggggagagaggaaaaggaggtatttagggagaggggagaggagaaaggagggagagaggtgtggggggagaagaggaggaaggagggggagttgggttaggtagggggggataagggtgtgttggatgtgttgttgtgtgttttggtggggagtgtgtttttaagggggaagtgttttgaggaagatttttgtatggggttgagtttggaaagaaggtgttgggatttgtgtttatttattgtttttggaggttgtggtttttgggtttggtgggggttggggggagagggtatttggtgggttgtttgtggttaggttaggagagggagatttggtttaaataaagtgatttaggtatttttaggaatttttggtgtttggggtttttttgggtagtttttgatttttatgtgttttttgggtttttagggatgtgggtatttgtggggtggggttgttgggttttggggtttggtttttttgggtggttggagtgagattttgggttgggaaagttaggtatgtggttggtttttggttgtatttttgttttatttttatggtagggtttttagtgtttgattaagtttaagtttgagttttttggtgtgttgtttattggttgtttttttgtgttttttttttttttttatttgtattgttttgttttttattttttttttgttttttttttattatttagtttatattttttttgtttttttttttgttttttgtgggtatttgagtgtttgggaggtgtttatttgtttgatttaaatatttatgtgatttttagtgtttgttgtttgtgtgtttgtttttgttttgttgttggttattgtgttttgttagtttatattgggttgggttttgatggtgtgtgagttatagttgtaaagtaataggataattttggggatgttgttttagtttagatttgggtatgtattgtttgtggagatggtattgttggggaggggagttatgtggattttagatgtggttttttaggtggatagatttttgtttggggtgtaggaggaggtaggattggtattgtggggtgggagttttggatttttgagtaattttggatttggtttgaaaagtaatatttttattattaaattgtagaattagattttgatggagaaaatgggttaggggatttatttttattttatttttttaaatttagattttttgttattatagattagttttgaaaaaagtttgtgttttaataaggatggggaattgtttttgtggaattttgtggggaaattgttaaaaaaaaaaaaaaaaaaaaaaaaaaaaataattaaaaaaaaattttgataaggattttattttttgatttttttggttgtatttgaagaggaagggtaatttttattgattttttatgttattatttatttatggtggaattagtagagaagagaaaatgagatagttatagtgattgtttgtaattttgaaatagattgtttttaattttttaattttttttttgtaaaaagttttttttttttttttttttgaaagttttgtattgtgaataatttatggtaaataaggttttttttatagttgtgagtgtgaagtataattttataggtttagagtttagtgtttatttgttagaaaaataaaatgatgataagatattatattagtgttatgtaggtttttttttgtatatgtttaagattttgttgttaatagaaaatttatattttttttttaaaagagggtttaggtatatttatttatttgtattttttatttttgaaattaaatgtgtttttaaattaatttattttttttagtttattggatttttttatttttggtgatgtggggtaggtgg

SEQ ID NO: 191 - DNA, 3324 bp, Artificial Sequence
  chemically treated genomic DNA (Homo sapiens)
ttatttgttttatattattaaggatgagaagatttagtaaattggggagagtgaattggtttgaaaatatatttgattttaggaataaaaggtgtaaatgagtaaatgtgtttaaatttttttttaaaaagaaagtgtgagttttttattgatagtagagttttgagtatgtgtggaaggaagtttgtgtggtgttaatgtgatgttttgttattattttatttttttgatgggtaaatgttgggttttgaatttgtggggttgtattttgtatttgtggttgtagagggagttttgtttattatggattgtttataatgtaaagtttttagaggaagaaagaaaaaaggttttttatagaaaaaaagttggagggttaaaggtagtttgttttaaaattgtaaataattgttgtggttgttttgtttttttttttttgttggttttattgtgaatgaatggtagtgtaaagagttagtagaaattgttttttttttttggatgtgattagaggaattaggaggtgggatttttattagggtttttttttagttgtttttttttttttttttttttttttttttggtaatttttttatagaattttatgagggtagttttttatttttgttgaagtataagttttttttgaggttgatttgtggtagtggagggtttggatttggaggggtggggtgggaatggattttttgatttattttttttattggggtttaattttgtggtttggtgatgagagtgttgttttttgggttgagtttgaggttgtttggaggtttagggtttttattttgtgatgttagttttgtttttttttgtgttttgggtaagggtttgtttgtttgggggattgtatttggaatttgtgtggtttttttttttggtggtgttgtttttatggatagtgtgtgtttgggtttgggttggagtgatgtttttgagattattttattattttataattgtggtttgtgtgttgttaggatttggtttggtgtgggttggtggagtataatgattggtggtggggtgggggtgggtatgtgggtggtgggtgttgggggttgtgtagatgtttgggttgaataggtgagtgttttttggatatttgggtgtttgtggggggtggggaggagggtggagggggtgtaaattaagtggtgggaaagagataaaggaagagtgaagagtgagatggtgtggatggggaagggggaggggtgtggaggggtagttggtgggtagtgtgttgaggagtttgagtttgaatttgattaagtattgggggttttgttgtgggggtggggtgggggtatggttgagagttggttatgtgtttggtttttttagtttggggttttgttttggttgtttgggggagttgaattttgaggtttggtagttttgttttataagtatttgtgtttttggggatttgaaagatgtatgggggttgaaggttgtttgaaggggttttgggtgttgagagtttttgagggtgtttgagttattttatttgggttaagttttttttttttggtttgattgtagatagtttgttgggtgttttttttttttagtttttattggatttagagattgtagtttttgggagtgatgggtaggtatagattttagtgttttttttttgggtttagttttgtgtaaggattttttttgaagtgttttttttttaagagtgtgttttttattgaagtgtatggtggtgtgtttagtgtgtttttatttttttttatttggtttagtttttttttttttttttttttttttttttgtgttttttttttttttttttttttttttttttttttgggtgttttttttttttttttttttttttttttgtgtttattttttttttttatttgtttttttgttatttttttttgttgttttttttattttttttgtttgtgttttttttgtgttttttttttttttgtttttgttttgtgtttggttttgtttttttttttgtttttttgtgtttggtgttttttttttttttttttgggttgtggtgttgttgttgttgttgttgttgtttgtttgggttttttttttggttatttttgtttttgggttgggtagtgatgtgttgtggtggtgttagtttttttttttgggtagttgtggtggtagtagtagtagtagtagttggagttgtggggttgttattgttgtttgttttgtttatttgtggattttgattgtttatttttgttttgtttttagtttaggtatggagtttggtttggattttggtgattgggttgtttttggggtttgggttgttgttttttttttttggttgttgttgttggttgttgagttgtggttaggggggtgaggggttgggggtggttttggggaggggggtgtagggggagttttttttgttggggttgagggagggggtgtgggggagtggttgtgttttgggttgagtgggttggggtggggggtgggtgagtgtgtttgagagtggagggggggtgatgaaggttgtattgtgggggttgtggggtgtttaagaggtgtgtttggttttgagtgtttagggttgtggggtgtattttatttttggggtgtgtgttgtgggttttggggggtggtgattgtgtgtgtagtgttgtggtattgtgttatggttgtttggtgtgtagtgggtttggtattgtgttttggtgagggaggtgttttttggtggtggggtgggggttgggtttgggttgttgtggttgttatgagaagggaagtggattgtgtttggggatgtgaggatgggaagtgttgagtgttagggaggggttttttggtgtggtgtggggagttgagatgtggtttgtagagttgagtttattttagtaggtttgggttttttttgggaggggatggggtgttttttttaggtgtattgtttgattggaagttgtgggtgttggtggtttttggtgaaggggttttttttaatgaggggatatggtggggtgggggtagttggttgttttgagggtgtgtgtaggggttaagttggatttatatttttgtttttttttttttttttttattttgtttttaaggttggatattttggatagggaggaggggggagtgtaatttgtatttttattttagttgtttgggagtagaagtgattttgtttttatttggagttgtgtttgtttgagtttggttgtttttattgggttgtgttttttgggggaagtttttattaagttttgttaattagtattatttttgtagaaaggttaaggttaga

SEQ ID NO: 192 - DNA, 4431 bp, Artificial Sequence
  chemically treated genomic DNA (Homo sapiens)
ttatagttaatgtttaatattttaatttttttaggtttagaatttttttaggattgattttgtgtttatttgtgttaaaatgtgttaaattagataggaaggggaagtataaaatttaatttataatttaaggtaagaatttgagttttggtttgaaaaatgaaaagttatggagtgatataatatattttgattttttaaataattaagatatttaattttaaagatattttttaaataagagatagtttaagtttagattgtttatagggtattagtttttagaaaaatgttatggttagagatagatttgaaatggagatatgttttaagtttagagttttggagttattattagatagtatgttaggagaagataatgagaaaaaggagagatttatattaattttgttttattttttttttggaggtatatagttttgggttgatttttgggattagttgatttattggttgtgtttttttggtgtttgttgtttgtttggaaaggtagttgtttgttgaagaggaaaagttgggaatgtaatttttaatttttaggataatgtttagtattatgttttatttttaatttgttttttttaaatggaaatagataaggttattttgaaattatttagttatttatgaaatagagtttataattattttttttttttttttaatatgattagaagggtgattttttaaatgtggttttttttatagttatgtttggaggggtattttttagtgttttagtaagtgtttttagtgatattagaatgttagttaagatttaagatatatttttttagttgttttttgttatttgttatagaaaataatgttgttgtatgtttttaaaatgttgttttataagtagatttggtttttagtaattggtgaggaaaagttattggaattaaatattatttatatagttatttagagtggaggttattgttttattttggtagaggtatatgggggtagtaggtaggattgagaggggtttgaaggtgttgtaggaggagaggttgggtgtagatggtttggttttaaattatatttagtgttaggaaatgtaaggtttgggatgaatttttaagaagttgttgttagggatagggaggttgggagtagggagtgatgttataggaattttgaatttttttgagtttttttttaattaagttaaggttgagtaaggggtgttttatgtattgtaagtttttaatttaatattttggtaatgataaatagaattttttgattttaaaggttgtgaagtatgtgttttttggggttttgagtgagtttttaaatttttgtgttgattttttaaatttattttttgtttttttggaatgggtgtatgtgaggtatggattttaggaaatttttgttgtgatagtttatttatggtggaggtggaggtttgggatgttggatggagaaaggtggttagtggagggaggaggggtaggttggtaatgtggtggttttggatgtttgagttgtttggatgaagtgttggttttatttttgtttttggttgttgtggtgattttatttgagttgtgattttttttaagattttagggtttgggtttttttgttgtgttggttttagggtgttatttttggatgtttagatgtgttttggattttgtgttgggattttgaatattgttgtgtttttattttgtgttgagtgtgtttggttttgttttggttgtagtgggtatgagttttaggtgggtggtggggatgtagtgtttgtagtgtgattggtgtagttgttgaggtatggggtgtgttgtttggattttgattttgtggtgttaggagaggtgtgggtgttggttggagagttgtattttttgttttgttgaggttgttggttatgggtgtgtttgttttaagggttgggtggaggatttgttttggattttagaggatgtgggtggggaagggataaggatagggataagggaggggatgtgaattgggttgaggtgtgggttagttttggtttgggaagggaggttgttggtagggttattaggattttttttggatatggaaggatgggtttgttttggatttagggattgggaaatgtgggtttttttagaatttggggaagtggggagagggtttgttttggagtgtggagggagatttattttgggtttaggataatgggggtgggggtaggatgggaatgagggggtatttttggtgtagggaggggagatggagaagtagtagggggtttgttttgggtttgtgggttggggattatgaagtgtaggagggtattgtttaggattgggatgaggagggagaggggtttgttgtggttttggatagagggggagggaaagtgtgttttggtttgagaggaggagtaggagggttagttttggatttgggtttaggaagttgggagggaggtttggatttgttttagagatagggtgatgaagatttgtttaagttttggagtggagggaaggatgttggtggtgggggaagaggttggttatggatagggaaagggagtttgttttgtagggtggatgggtggttttggggaagggagaggttgtgatgtggggggtgtttggtttgagtggggttgtttattttgggtttgtagagttatttttggaatttgtttattattgttgtgttggttttggttggattttgggtggtttttgttttttgtagtgttgtgtttgggtttggttgaggtgtggggtggatgtggaggtatggttggagtttttgtgttgttgtagggaggttggttagtgaagtttggagtgttgagtgggtggtgggtaggtgtgtggggtaggtgtgtggttttgagtatgttttgtaagtggtgtgttgggtagattttagatttgggagtgggtgtttgggtgtatggatagatgtgggtatgggggtgtgtggttttttgttgtttattgatatttagtgttttgttggttatggttgttttgtgttgtatatgtgtttagggtgttgtgagttttgggtttattgtgtgttgtgggtggggtgggtggggtggaggtggtttaatttttgtgtgggtgttgtattttgtttgaggtgtgttttttgttggtggggtgatttgttgtgtttgggtatttaagaaattataagttttgaaaggtatggtggggaggtggtgtttagggtttggtgttttgggttgtgttgtggtgttgtgtattgtgggagttgtagtttatttgatggtggtggagtgtgttgttggttgttaggtgatgatgttaaatagttgtggtgttttgtttattgggagttgatggatgatgattgttaatattttagttttagttggtttaggaaattgttgtggtggtaggtggtggtggtaggagggtttggttgttttgagtgtttgttaggtatgggggtgggataggtgtggggtgatgtgttgttgatttttatgatttgttggttggtttttttttgtttgttgtttattttgttttttttaaatattttttttgttttttttttagttttttgatgaaagtgaatggtgtttttttttttttttttaaattattattattagtggtgtgttttaaaaagatatttttttgtttttgttattttttttagtggtgttttaatttgtattttaaaatgtttattttaatttgagtatttgttatgtgttaagtagagagttaaaaatttatatgtggttttatttaaattttttattgatagttagagaagtaggtataatgaggttggtgtgttttggttgtgggggttgtatttagattatggtggatttgggttggtttgattttatagtgttgtatttttttttgttgtattattattatgtttttggtttgttgtgaaatgtgtagatgtaagatataggagatggaagttatgttttttttggtttagaattgagaagtttgatttgtttttgtttgtttttattggttagtgttaggtgtttagaaaggtttgtgggttttatgattattttattttaatagatgtgatgtgagtttaggtgtgttggtatttaagattttttttagttgggggtagggtttatgtttatttttgagtaattgattgattttttttatttttttttttttattatttagttgattttttgaagggtaaaatttttttggagtttttttttatttttaatttttttttatttgttttttttggaaattatttttattagatttttatttaattatttttttgaagttttttattaaagttatttttgattttgatgttgtaaaatttgatgattggggttagtgtttattttttttttgaattgttattattatgtgatttagttgattgtgttttttt

SEQ ID NO: 193 - DNA, 4431 bp, Artificial Sequence
  chemically treated genomic DNA (Homo sapiens)
gagagggtatagttggttgggttatgtggtagtgatagtttaaggaagagatgagtgttgattttgattattggattttgtaatattaaggttaaggatgattttgataaagagttttagaggagtggttgggtgaaaatttgatgggagtagtttttagaaagaataagtgggaaggaattggagataaggggaaattttagaggggttttgttttttagagggttgattgggtggtaggaagaggagagtagggaaaattaattagttatttaaaaataaatatggattttatttttaattaagagaaattttagatgttagtgtgtttaggtttatattgtgtttgttggaataaagtggttatggagtttatggatttttttgagtatttggtattggttagtgaggataagtaggaataggttagattttttaattttgaattgaggggggtatgatttttattttttgtgttttatatttgtatgttttataataagttagagatgtggtggtggtgtggtagggaaaagtgtagtgttgtggggttaggttgatttagatttgttgtgatttggatgtaatttttatagttagggtatgttggttttgttgtgtttgtttttttggttgttaatgggaagtttaagtgaggttatgtgtgggtttttagttttttgtttgatatatagtaggtatttagattgaggtgagtgttttaaggtataaattagggtattattggggggagtagtgagggtggaagagtatttttttagaatgtattgttgatagtggtgatttaaaaaaaaaaaaagaggtattgtttatttttattggggagttgggaagaagatagaagaggtgtttgggagaagtaagatgagtagtgagtgagagggaattggttggtaggttatgaaaattggtggtgtgttgttttgtatttgttttgtttttgtatttggtgggtgtttggggtagttgagtttttttgttgttgttatttgttattgtagtagttttttgggttagttggggttaaggtgttggtagttgttgtttgttagtttttggtaggtaggatgttgtggttgtttggtgttgttatttagtaattggtggtatgttttgttgttattgggtggattataatttttataatatatagtgttgtggtgtggtttgggatgttaagttttgggtgttatttttttgttatgttttttgggatttgtagttttttggatatttgggtgtggtgggttgttttgttggtagggagtgtgttttgggtggggtgtggtgtttgtgtagggattgggttgtttttgttttgtttgttttgtttgtagtgtgtggtgggtttggggtttgtggtgttttaggtgtatgtgtggtgtggggtggttgtgattagtggagtgttgggtgttagtgagtagtgaggagttgtgtgtttttgtgtttgtgtttgtttgtgtgtttgagtgtttatttttgggtttgaggtttgtttggtgtgttgtttgtagagtatatttagggttgtgtatttgttttgtgtatttgtttgttgtttgtttggtgttttgggttttgttagttagtttttttgtgatagtgtgggggttttggttgtgtttttgtgtttgttttgtgttttagttgggtttgggtgtagtgttgtggagggtgagggttgtttggagtttggttagggttggtgtggtgatgatgaataggttttgaaagtggttttataaatttaaggtgagtggttttgtttgggttggatgttttttgtgttgtggttttttttttttttaggattgtttgtttgttttataagatggattttttttttttgtttgtggttggtttttttttttattgttgatatttttttttttattttaagatttggatagatttttattgttttgtttttgaggtggatttgaattttttttttggttttttaagtttgggtttaggattgatttttttgtttttttttttgggttggggtgtattttttttttttttttatttagggttataatgggtttttttttttttttattttggttttggatggtgtttttttatattttgtggtttttagtttgtgggtttggagtagattttttattatttttttgttttttttttttgtattaggaatgtttttttatttttgttttgtttttatttttattgttttgggtttggaatagatttttttttgtattttagaatagattttttttttatttttttaggttttgagagaatttatattttttaatttttgggtttagggtagatttgtttttttatgtttagagaggattttgatggttttgttaatggtttttttttttgaattaggattgatttatattttggtttagtttgtgtttttttttttgtttttatttttgttttttttttatttatgttttttggaatttgggataggttttttgtttggtttttggggtgagtgtgtttgtggttagtagttttggtggggtgggaggtgtggttttttagttggtgtttgtgttttttttagtgttgtggggttggggtttgggtggtgtgttttgtgttttagtggttgtgttagttgtattgtgggtgttgtgtttttgttgtttgtttggggtttgtgtttgttgtagttggagtagggttgggtgtgtttggtgtgggatgaaggtgtggtggtgtttaggattttggtgtagggtttagggtgtatttgggtgtttgagggtggtattttggggttggtgtagtggggaggtttgggttttgagattttgggggaggttatggtttgggtggggttattgtggtgattaagggtgggagtggggttagtgttttgtttgggtagtttggatgtttgaggttattgtgttgttgatttattttttttttttttattggttgtttttttttgtttagtgttttaggtttttgtttttattgtgggtgagttgttatggtagaggttttttgaaatttgtgttttgtgtgtgtttattttaggaaggtgggaggtgggtttggaagattggtatggaggtttgagggtttatttagggttttgaagggtgtgtgttttatggtttttgaggttggggaattttgtttgttgttgttggagtgttgggttgagggtttatggtatatggggtgttttttgtttggttttggtttgattgggaggggatttggggggatttagggtttttgtggtgttattttttgtttttaatttttttgtttttagtagtgattttttaagggtttgttttgagttttgtgttttttggtgttgggtgtggtttggggttgagttgtttgtgtttagtttttttttttgtggtgtttttgagttttttttggttttgtttgttgtttttatgtgtttttgttggggtagggtggtggtttttgttttggatagttgtatgaatggtgtttggttttagtgatttttttttattagttattgaaaattaagtttgtttgtaaaatggtgttttgggggtgtgtagtagtattattttttgtgataaatggtgggaggtagttggagaaatgtgttttaggttttaattaatattttggtgttgttgaaggtatttgttgggatattaggggatgtttttttggatgtggttgtggaagaggttgtatttgggggattatttttttaattgtgttgaaaaggaaggaaaaataattgtagattttgttttatgagtagttgagtaattttaggatggttttgtttgtttttgtttagggaagataggttaaaggtagaatatggtattagatgttgttttgagaattaggaattgtgtttttaattttttttttttagtaggtagttgtttttttaggtaggtggtgggtattaagagggtatagttagtgaattagttgattttagggattagtttagagttgtgtgtttttggagaagggatggaataggattgatgtggatttttttttttttttgttgtttttttttggtatgttgtttggtagtagttttagagttttggatttgagatgtatttttattttagatttgtttttggttatagtatttttttgggagttggtgttttgtgggtagtttgaatttgggttgttttttatttgagaaatgtttttggagttaaatattttgattgtttgaagggttggagtatgttatgttattttatagttttttattttttaaattaaagtttagatttttgttttggattatgaattgaattttatgttttttttttttgtttaatttaatatattttggtataaataagtataaagttagttttgggaagattttgggtttggaagagttgaagtgttaaatattagttgtgg

SEQ ID NO: 194 - DNA, 3357 bp, Artificial Sequence
  chemically treated genomic DNA (Homo sapiens)
tgaaatttaaatataaaatttgttaataaggattaattgtatgtgtataatttaaattttatttataaatttaattatattatttgattttattagaattaggttttattttatttttgattttgtttattatttatttagtatttttggtaataggtgtttgagtgtttataggtggtttttgatttgtgaaagattttgtggtgtttttagttagggtttagggttgggtagtttagttagtttttagttatggaggttataggaagtagtagtagtttgaaagggggtggaagggatgagggaaattgaggttttaggaagggataatattgtgttttaggttatataaattattggtatttattagtgtttgtttaagttttaggatttgttataggtaattagtttatatatggaaaagaaattttttatatttttattttatttttttttattttgggtttaggatattattattttttaatttaaggatttttgttttttatttttagtgttttaattttttatttttttttatttttagattgataatttattatttttttttattgttaatttagaaattttttattttttttttttatttttttttgttattgatttaagggtttttatttttttattttattattttaagatttttatagtttttatttttagttttaaagggttttattttttttgtttttattatttgattttagtagttttttattttttttttttttgatttaggagtttttaattttttttttttagtgttttaattattttattttttttttgtttgatgtttttttattttgttattttagtgttataattttgattttttttgtgagatataattgttttaatttatagtttgaatagttttttattttttttattttttatattggaagttttttatgtttttttttttttagtttaagatttttttttttatttttttttttttttaatgtttttatttataatttttttttagtttgagtttttaaatttttttttatagttaaaaagttttttattttttttttttattgtttttattttttattttttttttattatttagagagattttaatttttttttttagtattttgaatttttttttattttttttgtttttgttttgggattatgttatttttaattgttattattttgattttttattgttttttgttttttatatggggttttttattttttttttttagtattttaaagtttttattttttttgttattagtttgagggttttttattttttttttttagagttttgaatttttattttttttttaattttagatgttttgatgtttttttttagtgttttgatttttattatttttttttgtttttgttttaggattttgatatttttatttgttagagtttagagttgtatttttttttgtttttagtttaaatttttttatttttttttgttagtattttgatgttgttattttttttttttattggtttgagggttttttatttttttttgttagtgttttgagttataatttttttttattttttgtttgagtgttttttatgtttagttttaaggttgttttattagtttggtattaggttggtattttttgttattttaggtttgtggatttatggtgagggttttttttgtattttttgttttgttttttttttttttttttttttttgtggttgttttttttgaagtggtagttgttgtttttgtggttgtttgttgtttttggaattggaagtttgttgtttgttttttgggttttgtttttggttaagtatttgtgtattattgttttgatgttgtgtgtttttaatagggaggtttttgtgtttatgggttggtgttttgtagtggtgtgtgtgtttttttgttgagagttagttgtatttgtgtgttgatgtttaatgatagttaatttttttgagggattggtagttgtggttttttttgttgtttatttagttggtgtatgtgttttttagttttaatttgaagggaagtggttggggagggtttgtgtttgtgttttttttttttttttgtggtttttatagttgatattgaatgtggtaaggaagttgttttgtgtttgtgtattttttggttttgttggtgttttttttttttattttttgttggggtttattttgtgtttgtgggtttttttgaatattaattttagggggggttgtgttttgtttttttttttttgttgaatagttgtgggagtgtgtggggtggggaaaggggtggtgttatattgtaggtaaattgaggtatgtgggagggtgtgtttttgtaggaggtggatttttaatgtggggtttgtggggaaaaggtggggtttggtgtttatagtggatgatagttttgggtgggagataggagtatgtatgggtggtgttattatattgaaggtgtgttgtgtagattttttgtttgtgggaggttgggaatgtgggtttttgggtttttgtggggtgtaggtgttttttattttatttagaagtttggaatagttgtaattgtagtaatgtggagatagtttttttggtttttttaaaattttattaataaaatttagggagaggaggtaaggatgagtggattttgtagttttattaggtattgaatatgttgatggggatagtttttttgataaaggtagatgggtggttaattggtggatgggtatagggagaattggagaaatagatgagtggaggaatggatatatgggtattgggtggtttttttatttggaatgtagggtgtaaggggtttgggttaggaggtttagtggttggtattggagtgtaggttggtagtgaggggattgtgttggattgtttggtgtagtattagggttagtaattttgtgtggtttgttatggttgtgtgtatattgtgtttttgtttaaatagtttgtttagtttgtattattgttaagggagtggtaggagttttaagtaggaatatttgtagttttgtttgttttggttatgtttgatatggaaatttattatatgtagtattaaaattgtatagaaatttattatatgtatgtgttttaagtttatttttgtatgttgtagttttttttagtagtaatggtgattgtattggtgtttgggtaggtggtagaagttatttgtgagtttaaagatattatgtataagggggtatttgtatattttgttagttggtatttgtaaggaggttaggttggggggatgaatagtggtgataagggagaataggaatgggggtttaaggagggagaaggaaaagaatggag

SEQ ID NO: 195 - DNA, 3357 bp, Artificial Sequence
  chemically treated genomic DNA (Homo sapiens)
ttttatttttttttttttttttttttgagtttttatttttatttttttttattattgttatttatttttttaatttggtttttttgtaggtgttagttgatgaggtatgtgggtgtttttttgtatgtgatgtttttgagtttatgggtgatttttgttgtttgtttaagtgttagtgtaattgttattattgttgggagaagttgtggtgtgtggaagtggatttggagtgtgtgtgtgtggtaggtttttgtgtggttttggtgttgtatgtggtaggtttttatgttggatgtggttggggtaggtggggttgtaggtgtttttgtttaggatttttgttgtttttttggtagtggtataagttggatgagttgtttgagtaggagtgtaatgtgtgtatagttatgataaattgtgtgggattgttggttttgatgttgtattagatgatttagtatgatttttttattattgatttgtgttttagtgttgattgttgagttttttggtttggattttttatattttgtattttagatgggggagttgtttggtgtttgtgtgtttgtttttttatttatttgtttttttggttttttttgtgtttatttattggttgattgtttatttgtttttattagagggattgtttttgttgatatgtttagtgtttggtggggttgtggagtttatttatttttgttttttttttttgggttttgttaataaaattttgaagaaattaaggaagttgtttttatattgttgtggttgtaattgttttagatttttggataagatggggggtgtttgtattttgtgagagtttagggatttatatttttagttttttatgggtagagggtttatgtagtgtgtttttagtgtggtgatattgtttatgtatgtttttgttttttatttagagttgttgtttgttgtggatgttaggttttgttttttttttataagttttatgttggggatttgttttttgtaggggtgtgtttttttgtgtgttttagtttatttgtggtgtggtattgtttttttttttgttttgtgtgtttttatagttgtttggtggggaggagggagtgggatatgattttttttggggttgatgtttggagggatttatgaatataggatagattttagtgagaggtgggagaggagagtgttggtagggttagggagtgtgtaggtgtgaagtagtttttttgttgtgtttggtattggttgtggagattgtgggagggaagggagggtgtaggtgtaagttttttttgattgtttttttttaggttgaggttggaaagtgtatgtgttagttagatgggtagtgaggagagttgtaattgttagttttttgaaggggttagttgttgttgaatgttagtatgtagatgtaattggtttttggtaggggggtgtgtgtattgttgtggagtgttggtttgtaggtgtgggagtttttttattaagggtatgtgatattgaggtaatagtgtgtaggtgtttagttagaggtggagtttgagaggtaggtagtggatttttggttttgggagtaatgaatagttgtggaggtgatagttattgttttagaggaggtggttgtggaggaggaggaaggggaggagggtgaggtgggaggtgtaggagggatttttgttatgggtttatgggtttagagtggtggaagatattggtttggtgttaaattggtgagatagttttggggttggatgtggagagtgtttaggtggaggatgggaaggaattgtggtttagaatgttgatggggaggaatgaagggtttttaggttgataagggggaggaatggtggtgttggaatattgatgaggagaaatggggggatttaggttgaggatgggaaggaatgtagttttgaattttgataggtaggagtgttgggattttgggatgaggatggagaggaatggtggagattagaatgttaaagggagatattggggtatttgaagttgagagagaaatgggggtttagaattttgagagggagaaatgaggggtttttaggttgatgataggagaaatagaggttttggaatgttgaaagggaggaataggaggttttatatagaggatgaggagtagtaggggattagaatggtgatagttagggatggtatgattttgggataagaatagagagaatggaggagggtttggaatgttgaggggagaaattagggtttttttggatgataagggaggaatggaggatgagaatagtaaggaggagaagtggggaattttttggttgtagaggaaggtttgggagtttagattagggagaaattgtgggtgagaatattgaaggagaagaaaaataaggggggaggttttgggttgaggaaggggaggtatgggaggtttttagtgtgaggaatggaaaagatgaggggttgtttaggttatgggttggagtagttgtgttttgtagaggaagttgaggttgtaatattgaggtagtaggataagaggatattaggtagagaaggaatggagtggttaaaatattgaaggagggaaattaggaatttttgggttaaggaaggggggaatgagagattattgaagttaagtagtgagggtaagagaaatggggttttttggggttgaggatggggattatgggggttttggggtgataaaatagagggatagaggtttttaggttagtgatagggaggaatgagggggaaggatgaaaagtttttggattggtagtgaggagaaatgatgggttgttagtttgaggatagagaggagtaggggattaggatattgagaataagaaatagggatttttgggttgaggaatgatgatattttaggtttagaataggaaagaatggggtgagaatatgaggggttttttttttatatatgggttggttgtttgtggtaggttttagggtttgggtaagtattaatggatattagtgatttgtgtggtttggggtatagtgttgtttttttttagagttttagttttttttattttttttatttttttttaggttattgttgttttttgtggtttttatggttgaggattggttggattgtttggttttgggttttggttggaagtgttgtgaagttttttgtaagttaggggttatttgtggatgtttagatatttattattagaggtattgggtgggtagtgggtagagttaggagtggggtagagtttgattttggtaaaattaaatggtgtggttaaatttatggatgaagtttaaattatgtatatatagttaatttttattagtggattttatgtttgaatttta

SEQ ID NO: 196 - DNA, 2170 bp, Artificial Sequence
  chemically treated genomic DNA (Homo sapiens)
gtgatttttttttttaggatttagtagtattttattgtgttatagtagttagtatttttaaagtatatattttaatattttttggttgtagtatatttaatttttttgttggggtgtgggggtttttttttttttgagtatagtttttggttttttgattttttttgttttatttttttgttttttaagtatattgtgtttatttttttaggtagtttttttagtggttgggtagtagtagggttttgagtttgttttttttggggtggttatatgtgtttattttttggggttggggattgttttttttgtttggttgttgattggtgtttttttttattttattttttttgttgttttttagtttttattttattttgttttagtttaattagttttattgttttttttttttggagaaaaaagttattttagagttttttgggtgttgtttttggttggaataaaagtgttaagaaataggtggaaagtattttatttttttaggttttatatttttagggtggatagtttgtttttgttttggttttgtttttggtattaataataattgaatttttatatgtgtatgtttttgtttttagtttgattgaaaggattattttgtgggttttttaaaaggatgtgattatttaggttaagtgggggtgggagagtttttggttgtttttttttgggaaagtgttttaattttttagttttaaagttttggagggtggagggtgttttgtgagagtttttgggggtgtggtttgtgttttttgggttttgtggatttgggtttgggggtgtgtgttttgtttttttttttttttggtggtgtagttgtttgggtgggggtggggtgggggttggggtttgtgtgggattaattaggattggggtgggagttgattgtggttggtggggagggttagttttgttttggtgggtgggtgtgtggtaggggtttttggaggttttgagtttttgggaggtgttttggttaattttgggttggtggggattgggtttgggtgtggggttttgaaggtgtggaaggaaagtttgggattttgttatttttttatagtgtttttttttttgtaatatttagtttttttattgtggggtttgggagtttttggagttgattttgttattattatttttttgggtgagtgtggaggatgggttggttattttggttaggttggaggtgttttttagtttggggttttgtgataattgggttgaaatttgagggttttggagtgtggtgggtggtgggagtttgtggagtgtggtgtatttggtggttaggtattggttagtttagtggtagtttttttttttttatttttatttttatttttggaaggagttgagaattagttgattggttggtaggttgaattgtttttttttttatggtaatatgtgttgtgattttttattttttgtttttggataaaggtgaatggtaattgtgttggttagtttttgttttttgttttgtggatgggtttgttgatgtagtaattaaaattagagttatttttttggaagagtaaattgttgttgttgtttttttagttttatggattttattttgtgttatttttgggttgattttaatttgtttattttagagttttttgttttatttttatttttagatttagttgtgtttgttgaaatattagttgttttttttgtgaatgaagtgtgggaatttgtttttgttgtagttaatgaaattaggaaaataaaaagattaaaagggttggggatgggagaatgaagaggaatgtagatagatagtttagggttatttattggtttttggtgatttttagttttttaagttgattaaaataatgtgaggaaatgtgggtttttttattttttaggaagaggtaataatgggtattttatgtggtgttatagtgtttgtttttaaagtttgaatgtgaatgtagtaagtataattttattaatgaaaatattttttagataattgttaatattgatgaaagaagagaaatagagatatggaagttaaagagttgggaattttaaaggttaaaggatgttttttagttattttgatgttttgtgtttttttttagttggtataaaattgtgagtagtttaattatattttgta

SEQ ID NO: 197 - DNA, 2170 bp, Artificial Sequence
  chemically treated genomic DNA (Homo sapiens)
tgtaggatataattaaattatttatgattttgtattaattgaaagaaaatataggatattagagtaattgagaaatattttttgatttttaggatttttaattttttagtttttgtgtttttgtttttttttttttgttaatattaatagttgtttaaagaatatttttattaataaaattatgtttgttatatttatgtttaaattttgaaaataaatgttgtggtgttatgtaaaatgtttgttattatttttttttaaaaagtggagaagtttatatttttttatattgttttaattagtttaaggaattaagaattgttaaaagttagtgagtggttttagattatttgtttatatttttttttatttttttatttttaatttttttgatttttttatttttttgattttattaattgtgatgagagtaagtttttatattttatttatagaagaagtaattgatattttagtaaatatgattaaatttaaaaataaaggtgaggtaaagagttttgaaataaatgagttaaaattaatttgaaaatggtataaagtaagatttgtggggttggggaggtaataataatgatttgtttttttaaaagagtggttttaattttgattattgtgttggtgaatttatttgtagaatagaaaataaaaattgattaatgtagttgttatttatttttgtttaaaggtaaaaggtgaaaagttatgatatatattgttatagaagagaaggtaatttaatttgttaattaattgattaatttttagttttttttaaaaataaaaataaaaataggagaaagggggttgttgttgggttggttgatgtttggttgttgagtgtgttgtgttttgtaagtttttgttatttgttgtgttttaggatttttgggttttggtttagttattataaagttttgggttggaaaatatttttggtttggttagaatggttagtttgttttttgtgtttgtttggggggataatggtggtgagattaattttaagggtttttgagttttgtgataaagaggttggatattatgggaggaaggatgttgtggaagaataatggagttttaaattttttttttatatttttagagttttgtgtttaggtttggtttttattggtttgaagttggttggagtgttttttgggagtttggggtttttgggagtttttgttatgtgtttgtttgttagagtggggttagttttttttgttggttgtggttgatttttgttttggttttagttaattttatgtgggttttggtttttgttttatttttgtttggatagttgtattgttagggagggggaggggtggggtgtgtgtttttgggtttagatttgtaggatttagggggtgtgggttgtatttttgagaatttttatgaggtgttttttgttttttaggattttgggattggggagttgaagtatttttttaagggaggatggttaggagtttttttatttttatttggtttgagtggttgtgtttttttaaagggtttgtggggtggtttttttggttgggttagagatagaaatgtgtatgtgtgggagtttagttattattgatgttgagggtagagttggagtaggagtgggttgtttattttagaaatatgaagtttagagaagtgaagtgttttttatttgttttttaatgtttttattttagttgagaatggtgtttaaggagttttgaagtggtttttttttttgagggaagaaggtggtggggttgattgagttggaatgaagtaggatggaggttggagagtggtgggaagggtggggtagggggaggtattaattagtagttaagtgggaagagtgatttttaattttagggaatggatatgtgtgattgttttggagaagatgggtttggaattttgttattgtttggttgttgaaagagttgtttggaagagtgagtataatgtgtttggaaggtggggggatggggtagaggaaattgggaagttggggattgtgtttggaggggaggagatttttatgttttggtggagggattgaatgtgttatggttgaagggtgttggagtgtgtgttttagaaatgttaattgttgtagtgtggtggagtattgttaaattttaagaaaaaaaattat

SEQ ID NO: 198 - DNA, 2251 bp, Artificial Sequence
  chemically treated genomic DNA (Homo sapiens)
ggattttgagttgtttttaggtagttaggagtggttttagtggtagttgtaaattttagtagttgtttgtgttgtttgtggttggggtggagggtagttagagttggggattaaggttttgtgttatttgtgtgtatagttttatatttgaatgttgtttttttgtagatgagattggtgggtattgtaaagttgggatttgtttttgaaggaaaaaaaatagtgagtaagaaatttagtattattttttattgatttattttgttgtattttttgttttttaagtttttgaaagttggtaattttgattttggtgtttaaaaattgatagttattgagattggttttgagaagttgaagatttggtagtttttagattgagtaggataaggtgaaagtaggttggaggtgggtttaggatatttgagggttgattttgggggtttgtgaggttgttattgttgttgttgttataggtgagatggtgttgggttgatgttggggttaatgggtagagaatgtagggatgtggtttttgttgaagagagttaagaagggaagagtgtgttttttaaattgtttttgtaatttgtttttagtgagtattttattgatttagaatttattgagaatagtattagtgagttattttttttttgagatgggttttatttattttggtaatggagtgagttggattgtggggaggaagaggaatgggaaaattagtttataaatattaatgttagtaagagtgtgttgttggtaggatgtattgtgagtttggagattttggtggttgtagttggtaagtggttataatttagaaagtaggattgagttgttttttttgttttattagtgtattgttttttgggtgtgggtttaatattttataagtggtaatttttgtttatggtagttttgttttttttttattatttttagatttagttttgtattttaaggttgtgtattgttagttattattatgtttatttttggggttaatttgtttgtttttttgagttttgattggttgaatagtttagtgattattttggtggtgatgtttatttttggggtggtgggtaatttggtggttattgtggtgttgtgtaagttgtgtaaggagtagaaggagatgattttttatatgttggtatgtgggttggttgttattgatttgttgggtattttgttggtgagtttggtgattattgttatgtatatgaagggttaatggtttgggggttagttgttgtgtgagtatagtatttttattttgtttttttttagtttgtttggttttagtattatttgtgttatgagtgttgagtgttatttggttattaattatgtttatttttatagttattatgtggataagtgattggtgggttttatgttttttgtagtttatgtgtttaatgtgtttttttgtgtgttgtttaatatgggttttggtagtttgtggttgtagtatttagatatttggtgttttattgattggattattaatgtgatggtgtatgttgtttatttttatatgtatgtgggttttagttttttttttatttttgttattgttttttgtaatgtgtttgtgtgtggtgtgttgttttgtatgtattgttagtttatgtgttgtattttgttgggtattgagtagtattatgtggttgtggttgttttggttgttttttggggttattttgttgtttttttagttttgttgtgttttagtgatttttggtgttgttggagtttttgttgtattgtgggtgttgagatttagatggttattttatttattgttatttttttggtggtgtttatttgttttattttgtttgtggtgagtgattggggttggggttttatttggttttttttttgtatttattttttgtgtttattttttgttttttgttttttttttgagtttttggtagtgaatgtgttgtttttaggttggggttgggatttttatattgttttttagagtaggtttaattttttttgaagttttaattttaatgagatttagtaggtgttttgtttttatattttttagtttatgtttttggaagtttgggtttttttttttattgagatagtttttattttttgttgtttgatattggttgagttttttaagaaaattttttgttttttttgttagatgtggaggggagtttgttgtagtgtgatttagtttatttttttgtattgtgaattgtgaattgta

SEQ ID NO: 199 - DNA, 2251 bp, Artificial Sequence
  chemically treated genomic DNA (Homo sapiens)
tgtagtttatagtttatagtatggaggaatgggttaagttatattatagtaggtttttttttatgtttaatagagggggtggggggtttttttggaagatttggttagtgttaggtagtaaggggtaagggttgttttggtggagaaagaaatttaggtttttgggaatataaattgggggatgtaggggtaaagtatttgttaaattttgttagggttgggattttaaagagggttgggtttgttttgagaaatagtgtgggaattttagttttgatttaaaggtgatatgtttattgttaaggatttagagggaaagtagggagtggggaatggatgtgggaggtggatgtgagaaaaaggttgagtagggttttagttttggttatttattatgagtgggatggagtagatgagtattattagggaggtggtaatgagtaagatgattatttggattttggtgtttgtgatgtggtggaagttttggtggtgttgaaagttgttgaggtgtggtaaggttggggaggtagtggggtggttttgggaggtaattgaggtggttgtggttgtgtggtgttgtttggtgtttagtgaggtgtggtgtatgaattggtggtgtatgtggagtagtgtgttgtatataagtatgttgtagaggatggtggtgagaatgaggaaggagttgaagtttgtgtatatgtaggagtaggtggtgtgtgttgttatgttggtggtttagttgatgaagtattaggtgtttgggtattgtagttgtgagttattgagatttatgttgggtagtgtgtaaaagagtatgttggatgtatagattgtaaagagtgtgaggtttgttaattgtttgtttatgtagtggttgtagaaataggtatggttgatggttaggtagtgtttgatatttatggtgtagatgatgttgaggttggataggttgaagaagagtagaatgaaggtgttgtatttgtatagtggttggtttttgggttattggttttttatgtatgtggtgatggttattgggtttattaataaagtgtttaataggttggtgatagttagtttatatattagtgtgtagaaggttgtttttttttgttttttgtgtgatttgtatagtattatgatggttattaggttgtttattattttgaagatgaatattattgttgggatggttattgggttgtttagttggttggggtttaaggaggtggatgaattgattttgggagtggatatgatagtggttggtggtgtgtagttttggagtgtaaggttgggtttggggatggtagaagagagataaagttgttgtgagtggaaattattatttgtaaggtgttagatttgtgtttgagaaatgatatattgataagataaggggagtaatttgattttattttttggattgtagttatttattaattgtggttattaaaatttttaggtttgtgatatgttttgttaatagtatatttttgttgatattaatatttataaattgatttttttatttttttttttttttataatttaatttattttattgttaagatgaataagatttattttaagggaaaagtagtttgttagtgttatttttgatagattttgaattaataaaatgtttattgaaaataagttataaaagtaatttggagagtgtgtttttttttttttggttttttttggtgagggttgtatttttgtgttttttatttgttgattttaatgttagtttaatgttattttatttgtagtggtagtagtggtggtagttttatgagtttttagggttagtttttagatgttttggatttgtttttaatttgtttttattttgttttgtttagtttggaaattgttaaatttttggttttttaaagttggttttagtggttgttgatttttggatattgaggttagagttgttagtttttaaaaatttgggaaataagaggtgtagtgggatgggttagtgaagaatggtgttggattttttatttgttatttttttttttttaaagatgagttttagttttgtagtgtttgttggttttgtttgtgggaggatagtgtttaggtgtgaggttgtgtgtgtaggtggtgtggagttttggtttttagttttggttgttttttgttttagttatgggtagtatgggtggttattggagtttgtggttgttgttgaggttgtttttggttatttgggggtggtttggggttt

SEQ ID NO: 200 - DNA, 2297 bp, Artificial Sequence
  chemically treated genomic DNA (Homo sapiens)
agaaaaatattattgtgtttttttgtttgtatttaatatatttaaggttttttatttatttttttggaataaatttttagtaaatatttatttattgatttgggagtgatggatttttataaaggtttgattgttttttaagtggttgaagtgatttgtttttgtggtttttttagtattgaagggggtgggggaagtggatttgagggggtgtatgtttttgttgttggtgggtttattttttaaaaattattgagatgtgttagggtggttgtgattaagtgggtttagggttaattgtgtgagggggaagtgttttttagagtgtgtgtagtgttgggggtttagtttatgttgttgtgtgtttttgtgtgtattgggtgaggatgttgagttttgtgggtattttggaagttgtggtggaggtaggggttttgtttggtgtagtgggtttgttggggaggtgtaggggaggttttgatttttggtttatttttttttagatttttttgtttgtttttggatttttagggtttttttttaaatttttttttgttttttttatgggaggtttttgtagtttttgggttttagggttttgtaagttttgggattgatttgtgtttggggtgggtgtggtggaagtttgaattggattatttaggtatgttatttgtagatgtagtgggtgagggggattttgttatttttttagttttttttttggattttgtagtgaggggaattaaattttttttatgatagtttttttggtgttagtttggattgagtggttataggttggattagggtaggtagaagatgtatttggtattttattgaatggtatttgaatttgtttttattatttattaatggtgtgattttaggtaatttatttaaattttttgaattttagtggtttttatttataatatgggggttaatgataatgttttttttgtatgtaggtggattaaatggatataaagtgtttatttttgtttggtatgtttaaaatttttattaataggttagttaattttattatgagaggaatttttttttttttgttttttagagtgtgggtggtatgaggttatggaagtagttgttgtaattagtattttaaaatttagagattttttaatggtggtagggggtgaaagggtaggggggaggtagggttgggataggtagaggtaggtttttggggatttttagttttggggattaagtgtttggaattagttgggtttgggtagaaataagaaggtaaatgatgggattgttgttggagtttggatttttatttttggagtttattgttttttttagggaatagaggagtgttttggttttttagtaatgaattaggagagtgtgagaaagagtatttgtttttttttttgtggtttgataagttattttttggtagttttgtgagtagattaattgaaatgggtttggaattttattttttttttttgatggagttgttggaggtttgtggatattgtttggttagtttttgggattatagtgttgtgggtttttttttgtggtgtttgttttaaatttgggtgttattaatttatttaataatgatggatgattttgttataatgatgttagttaaaatatttttggtttaatttttttttaattaatattgaagtattttgaatgagatttggatgaagtttgaatagtatgttttttaggtttagaaaatttgagtggtgggaagagaaaaagaaataagtagaaattaggaaagaatggttattaattgtttagattggtaagtgttaaataagttaggttgtttggaaaaagataaatgttgttttttttttttatggtatggttagaattttggtgatgggaaagtattttttgagttggttaattttatatattttgtttgtgttttttattatttattattgaaaatgttaggaagagttggggggtaagtgttttttttgtgggtgtgagattgtattgaagggttgttttggtataaagtttggggagaggatatggtggaggtggggttgtatttttattttgtttttttaatattaggttttgggtagagaaatttatgtgtgattttttgtggtagttgtaggtagttgattgtaaatagttttgtttgtgttttggagtagttgtgttattagatgtaatattggatatttgtttttgggttttaagaaggagagggaaagagttttttagaagataatttgagaaggggttagtagagtgttgggtggagtgtagatttt

SEQ ID NO: 201 - DNA, 2297 bp, Artificial Sequence
  chemically treated genomic DNA (Homo sapiens)
ggagtttgtattttatttagtgttttgttgatttttttttgggttgttttttggagggtttttttttttttttttttggggtttggagataagtatttagtgttatgtttggtggtataattgttttgggatatgggtgaggttgtttgtggttagttgtttgtggttgttgtaggaggttatgtataggtttttttatttaaaatttggtgttagaggggtagggtgggagtgtagttttatttttattatgttttttttttagattttgtgttagggtagttttttgatgtagttttgtatttatgaaggaggtatttgttttttagttttttttggtatttttggtagtagatggtagagggtataggtagggtgtgtgaaattgattgatttaggaggtatttttttattgttggggttttggttatattgtaaagagaagaaatggtatttatttttttttaaataatttaatttatttagtatttgttaatttgagtaattaatagttatttttttttgatttttgtttgtttttttttttttttttattatttaagttttttgaatttgggaaatgtgttgtttagattttatttgggttttatttaggatgttttgatgttggttggaagagagttagattgaaaatgttttgattggtgttgttatgataaggttatttgttattgttggatagattgatagtatttaagtttaaggtagatattatgagggaaagtttatggtgttgtggttttggaggttaattaggtagtgtttgtagatttttagtaattttattgggaggagaggatgaagttttaggtttgttttaattaatttgtttgtagaattgttgaagagtggtttgttgggttatgggagaagaaataaatgtttttttttatatttttttggtttattgttgagaaattaggatatttttttgttttttgggagagatagtgaattttagggatggaagtttggattttggtggtggttttgttatttgtttttttgtttttgtttaaatttagttagttttaagtgtttggtttttaagattggaagtttttaagaatttatttttatttgttttaattttgttttttttttatttttttattttttgttattattagaaagtttttggattttgaaatgttagttgtagtagttgtttttgtggttttatgttgtttatattttgggaagtggaggagggagggttttttttgtaataagattagttgatttgttaatgagagttttggatgtgttgggtgggggtaggtgttttatgtttatttaatttatttatatgtggagaaggtattattattaatttttatattgtagatggggattgttgaggtttggaaagtttagatgggttgtttaaggttatgttattaatgagtaatggagatggatttaaatattgtttggtaaggtgttaagtgtattttttgtttattttagtttaatttgtagttatttggtttagattgatgttagaggggttattatgggagagatttggttttttttgttgtggggtttagggaagaagttgagaaggtagtaaagttttttttgtttattatgtttataggtggtgtatttgggtaatttgatttaagtttttgttatatttattttgggtataagttgattttgaggtttatgggattttaaggtttagaggttataggaattttttgtgaagggggtaggagaaagtttgagggagagttttgaaggtttgggagtgaatgaaaaagtttggaagggaatagattaggagttaggattttttttgtatttttttagtaggtttattgtgttgagtggggtttttgtttttattgtggtttttgggatgtttgtagagtttggtatttttatttggtgtgtataagggtgtgtagtggtgtaagttggatttttgatgttgtgtgtgttttgaggggtgttttttttttatatagttgattttgggtttgtttggttatggttattttggtgtattttaatagtttttagaaagtgagtttattgatggtaaggatatgtatttttttaaatttgttttttttattttttttaatattgagaagattatggaaataaattattttgattatttagaaagtgattaaatttttataaaaatttattgtttttaaattgatgggtgaatatttgttgggaatttgttttagaggaataaatgaggagttttgagtgtattaaatgtaaatggggggatatggtggtgttttttt

SEQ ID NO: 202 - DNA, 2590 bp, Artificial Sequence
  chemically treated genomic DNA (Homo sapiens)
gtgttgagtaggtgtggttatggtgtttagattttttgggggtattttagtttttgttatttagtggtttatggttgtgggttttagggtttgaggttggggattattgttgttgttgtagtttttatattttgaagttgttttgttgtttgtgttgtttttgtagatagtatttttggtgttttgtgtgtttttttttttttttttttttttttatttgtttttattgttttgagtttttgaaagttgggagaattggagatatttttgaggattggtaatgaagttttatttaagtgggatgtaatttttgtttttttatttttttttaagaaggaggttgtgtttttattttgttttgttttgggtgttgatttttaaaaaattagagtaaaatgaatgtgaataaaaagaaaaggagaaatgttttgagttggggtagagggagtagagaaggagtttttattgtggttggaatgtagagtggattttggtttaggattgggtttttttttaggtttgggtttattttggtttttgttgttggaatttttaggaggtaaagtgattttgatttttgttgtttgtatttttgggtgtgagtgttttttttaggaggtttaggaggttgtttttgttgtattttgagtttttgttgtaaaaattgaagtttgtgggttttggtaggttttttagtttgtttgttttgggataggtttttgtttatatttttggaagtaaggagttttgggtttttttgttttttttggggtgtggagtttttggggtttttgaaaggtgaggttttagaggtgagggaggggtgagtggggagttttgtttgtttgtggttgtgtttttgttgtggattaggaggtaggttaattttttggattttgggggaaaaattatagtgggttttttgtggaaattttggttgttttaatttgttaagagtttgagtgaggttttggaagtttttagttttggtttaggttgggatgtggttgttgagtttttttaggtttgtaggatagtggtttttgttggtggtgttgttgtatttaggttttttttagattggtggtggtagttaatttgagatttgtgttttttgggtttggggtagttaggaggttggtgtgtagtgggttgggttaggattgggttgagtagatagagttgtagtttttgttttgtttggttttttgtggttggagagtagagtgatgttatttggagttttgtttgggtggtaatgagattttggttagttatttttgtagtttagattaattttttttaatagtttttgatggtaattatagtaattgaagttgttatatatttttaggtaattatgatatataaaaagttttgaggggattttttggtgagggaagttaagaatggttttttagttttaggaaattttggtttgttttatgttggagtttgtttggtttgttaaatgagaggagttttgtaatggggttaattagtttgttttgtgattttaagttattttaatgtggttgggtggtggagtttgaggtataggtttgttatgttttggaatttttgtgttttttttttttgggttttgttttagtttggttgtttgtttttaatttgttttgggagttgtggtttagaggtttgtttagaggtaggatttgtattggtggtggtttagagggtaatagtttggaagtttgggtgggggaatttgaggaggggtttttattttgtattggttttttttttatttttattgggttttttagagatgttgttatgggttttttgtttggatgggaagtggggaaaaagagattttattattgttttttttatttatttattttggtatttttaatagtgttatagggaagaggatagttggggtgatagtattgttgggttttaaatgtggattttggagtggttagagggtgtgtgttaagtagaggatggttgtaagatatggaaattaagtttattgtttttagagtgagtgtagtgtagtggagttttagatttggtttttgagtgattaggaatttttttgggtgtagtgataggtttgaaggagtggaggataagatttgttgtgtttttgtttggttttttttagttttttttttttatagtataatttttttttttgttttgtgggaggggggtgttgagttggtggttgttgtgttgtgtgttttttttgtttgtttttgttgttgtttgaatttttatgttattttttttgatgggttattggtggttttataggtaggtgttgttgtggggttgtaattatttggttgagtttggttgttattgaatatttttttatttttaagtatggttttttgtgtttttttttttttattttttttatttgagatgagtttgggatttatggtgtaagtttgtttggatgttttgggttttaggagtaagtttatatttgtggtgttttgaggttttttttgtgttatgtttttattttttttattttttttgtttagatgttttattgttgtttttttttattttaattttattgtagtttttaatttaagtgtttttg

SEQ ID NO: 203 - DNA, 2590 bp, Artificial Sequence
  chemically treated genomic DNA (Homo sapiens)
tgaaagtgtttgggttggggattatgatgggattgaggtgggaaggggtggtagtggaatgtttgggtgaggggagtaggggaggtgagggtgtggtgtggggagggttttgaggtattgtaggtgtaaatttgtttttggaatttgaggtgtttgggtgagtttgtattgtgggttttagatttgttttaggtggagggggtgggggaaggagagtgtgggggattgtgtttgggggtgagggggtgtttggtaatgattaggtttggttgggtaattataattttgtggtagtatttgtttatagagttattagtgatttgttaaaaagagtagtatgggaatttggatggtgataaaggtgggtaggggaggtgtgtggtgtggtggttattggtttggtgttttttttttatagggtgggaggggagattgtgttgtgggagggaggggttggagagggttaggtaagggtatagtgggttttgttttttatttttttgggtttgttattgtgtttaagggagtttttggttgtttaggaattgggtttggagttttgttgtattgtatttattttggaagtggtaaatttggtttttatattttataattattttttgtttaatatgtgttttttgattgttttagggtttatgtttggggtttagtagtattgttattttagttgtttttttttttgtggtattgttgaagatgttaagatgagtgagtgggaggagtagtggtggggtttttttttttttattttttatttggataggaggtttatgataatatttttggagaatttgatgagggtggagggaagattagtgtagggtgggggtttttttttggatttttttgtttgagtttttggattgttgttttttaggttattattagtgtgagttttgtttttgagtagatttttgagttgtggtttttggggtagattagaaataggtaattgggttggggtggggtttaggagggagggatgtgaaaattttggggtatagtgggtttgtgttttagattttgttatttagttatgttaaggtgatttggggttatgagataagttggttgattttgttgtaaagttttttttatttagtaagttgagtgagttttgatgtgaggtgagttggagttttttgaagttggaaaattgtttttaattttttttgttagggggtttttttggggttttttgtgtgttataattgtttaaagatatatggtagttttgattattgtaattattattagaggttgttgaaagaagttagtttgggttgtaggggtgattggttagggttttgttattatttaggtggggttttgggtgatattgttttgttttttagttgtgagaagttgggtaaggtgggggttgtagttttgtttgtttgatttagttttgatttggtttgttgtgtgttgattttttagttgttttgggtttgagggatgtaagttttgggttggttgttgttattggtttggaaagggtttaaatgtagtggtgttattggtgggggttgttgttttgtgggtttgagaaagtttagtagttgtgttttgatttgagttggggttggaggtttttaaggttttatttaggtttttggtaagttagaatggttaaagtttttgtaaggagtttgttgtggttttttttttaaagtttggagggttggtttgttttttagtttatagtgggggtgtagttgtaggtgggtagagttttttgtttattttttttttgtttttgaggttttattttttaagggttttaggggttttatattttgaaaaggatgaaagagtttggggttttttatttttaggggtgtaggtgagggtttgttttggggtgagtgagttaggaggtttgttgagatttatgggttttagtttttgtaatggaggtttagaatgtaatagaaatggttttttgagttttttgggaaggatatttatgtttgggaatgtgggtaataaaaattgaggttgttttattttttggagattttaatagtgagggttagggtaggtttgagtttaaagggaaatttagttttgggttagggtttgttttgtattttggttgtggtgagggttttttttttgttttttttgttttagtttgaaatatttttttttttttttttgtttatgtttattttgttttaattttttaaaggttagtatttaaagtaaaataaaatgaaaatataattttttttttggaggggggtaggagggtgggaattgtattttatttaagtgagattttattattagtttttagaagtatttttgatttttttaatttttaaagatttaggataatgagggtgagtgaaagggggagggggagggaaggaatgtatagagtgttaaaaatgttatttgtgaaaataatataagtagtaaggtaattttgggatatggggattgtggtggtaatggtagtttttagttttagattttggagtttgtagttgtgggttattggatggtgggaattgaaatgtttttgggagatttgagtattgtgattgtgtttgtttaatgt

SEQ ID NO: 204 - DNA, 17 bp, Artificial Sequence
  chemically treated genomic DNA (Homo sapiens)
ggtgggtggttagtgaa

SEQ ID NO: 205 - DNA, 28 bp, Artificial Sequence
  chemically treated genomic DNA (Homo sapiens)
ttattataacaataatacctaaaaaaaa

SEQ ID NO: 206 - DNA, 21 bp, Artificial Sequence
  chemically treated genomic DNA (Homo sapiens)
ggtgagtaagcgtttacgtcg

SEQ ID NO: 207 - DNA, 15 bp, Artificial Sequence
  chemically treated genomic DNA (Homo sapiens)
cgagcgtcggggagg

SEQ ID NO: 208 - DNA, 39 bp, Artificial Sequence
  chemically treated genomic DNA (Homo sapiens)
aaaacacatcaaaaccacaaaatttacaaaaacacaaca

SEQ ID NO: 209 - DNA, 28 bp, Artificial Sequence
  chemically treated genomic DNA (Homo sapiens)
tttagtatgtttttaattagagtgttaa

SEQ ID NO: 210 - DNA, 22 bp, Artificial Sequence
  chemically treated genomic DNA (Homo sapiens)
cctaacaaacttaactactccc

SEQ ID NO: 211 - DNA, 17 bp, Artificial Sequence
  chemically treated genomic DNA (Homo sapiens)
cgggatttaggcggtcg

SEQ ID NO: 212 - DNA, 23 bp, Artificial Sequence
  chemically treated genomic DNA (Homo sapiens)
attttcggaggttttcgattagg

SEQ ID NO: 213 - DNA, 25 bp, Artificial Sequence
  chemically treated genomic DNA (Homo sapiens)
ctcccaaaccctcattccaacccca

SEQ ID NO: 214 - DNA, 14 bp, Artificial Sequence
  chemically treated genomic DNA (Homo sapiens)
ccccaaaccctccc

SEQ ID NO: 215 - DNA, 23 bp, Artificial Sequence
  chemically treated genomic DNA (Homo sapiens)
tttgtttaggaatttgtagttgt

SEQ ID NO: 216 - DNA, 18 bp, Artificial Sequence
  chemically treated genomic DNA (Homo sapiens)
cgggttaggaagttcgcg

SEQ ID NO: 217 - DNA, 20 bp, Artificial Sequence
  chemically treated genomic DNA (Homo sapiens)
gacgtcgcgattgttttttg

SEQ ID NO: 218 - DNA, 26 bp, Artificial Sequence
  chemically treated genomic DNA (Homo sapiens)
ccccaccacaaacacctaacctcccc

SEQ ID NO: 219 - DNA, 17 bp, Artificial Sequence
  chemically treated genomic DNA (Homo sapiens)
ccctctacctccctact

SEQ ID NO: 220 - DNA, 16 bp, Artificial Sequence
  chemically treated genomic DNA (Homo sapiens)
ggagagaatagggggt

SEQ ID NO: 221 - DNA, 15 bp, Artificial Sequence
  chemically treated genomic DNA (Homo sapiens)
ggtggggcgtcgtcg

SEQ ID NO: 222 - DNA, 20 bp, Artificial Sequence
  chemically treated genomic DNA (Homo sapiens)
cgttacggtttttggtgtcg

SEQ ID NO: 223 - DNA, 40 bp, Artificial Sequence
  chemically treated genomic DNA (Homo sapiens)
caaactaaacctatcaaaaatcttttacaatcaacaaccc

SEQ ID NO: 224 - DNA, 27 bp, Artificial Sequence
  chemically treated genomic DNA (Homo sapiens)
ctaaaccaaataaaaaaaaataaaaac

SEQ ID NO: 225 - DNA, 22 bp, Artificial Sequence
  chemically treated genomic DNA (Homo sapiens)
gatgggtaggtatagattttag

SEQ ID NO: 226 - DNA, 24 bp, Artificial Sequence
  chemically treated genomic DNA (Homo sapiens)
ggatttttttcgaagcgttttttt

SEQ ID NO: 227 - DNA, 22 bp, Artificial Sequence
  chemically treated genomic DNA (Homo sapiens)
taagagcgcgttttttatcgaa

SEQ ID NO: 228 - DNA, 34 bp, Artificial Sequence
  chemically treated genomic DNA (Homo sapiens)
aaataaaaacacactaaacacaccaccatacact

SEQ ID NO: 229 - DNA, 23 bp, Artificial Sequence
  chemically treated genomic DNA (Homo sapiens)
ttttgagtgagtttttaaatttt

SEQ ID NO: 230 - DNA, 18 bp, Artificial Sequence
  chemically treated genomic DNA (Homo sapiens)
cctcctccctccactaac

SEQ ID NO: 231 - DNA, 20 bp, Artificial Sequence
  chemically treated genomic DNA (Homo sapiens)
tcgtttttttggaatgggcg

SEQ ID NO: 232 - DNA, 21 bp, Artificial Sequence
  chemically treated genomic DNA (Homo sapiens)
acgcgaggtacggattttagg

SEQ ID NO: 233 - DNA, 28 bp, Artificial Sequence
  chemically treated genomic DNA (Homo sapiens)
taaccacctttctccatccaacatccca

SEQ ID NO: 234 - DNA, 17 bp, Artificial Sequence
  chemically treated genomic DNA (Homo sapiens)
agtggagggaaggatgt

SEQ ID NO: 235 - DNA, 22 bp, Artificial Sequence
  chemically treated genomic DNA (Homo sapiens)
aactctacaaacccaaaataaa

SEQ ID NO: 236 - DNA, 20 bp, Artificial Sequence
  chemically treated genomic DNA (Homo sapiens)
gagttcgttttgtagggcgg

SEQ ID NO: 237 - DNA, 14 bp, Artificial Sequence
  chemically treated genomic DNA (Homo sapiens)
cgggcggttttggg

SEQ ID NO: 238 - DNA, 28 bp, Artificial Sequence
  chemically treated genomic DNA (Homo sapiens)
taaacaaccccactcaaaccaaacaccc

SEQ ID NO: 239 - DNA, 28 bp, Artificial Sequence
  chemically treated genomic DNA (Homo sapiens)
ctatatattataaaaattataatccacc

SEQ ID NO: 240 - DNA, 19 bp, Artificial Sequence
  chemically treated genomic DNA (Homo sapiens)
gggttaaggtgttggtagt

SEQ ID NO: 241 - DNA, 24 bp, Artificial Sequence
  chemically treated genomic DNA (Homo sapiens)
cgttagttttcggtaggtaggacg

SEQ ID NO: 242 - DNA, 15 bp, Artificial Sequence
  chemically treated genomic DNA (Homo sapiens)
cgcggttgtttggcg

SEQ ID NO: 243 - DNA, 37 bp, Artificial Sequence
  chemically treated genomic DNA (Homo sapiens)
ccacccaataacaacaaaacataccaccaattactaa

SEQ ID NO: 244 - DNA, 21 bp, Artificial Sequence
  chemically treated genomic DNA (Homo sapiens)
tacccttaataaaaaaactcc

SEQ ID NO: 245 - DNA, 19 bp, Artificial Sequence
  chemically treated genomic DNA (Homo sapiens)
ttaggttgaggttggaaag

SEQ ID NO: 246 - DNA, 22 bp, Artificial Sequence
  chemically treated genomic DNA (Homo sapiens)
cgaaggggttagttgtcgttga

SEQ ID NO: 247 - DNA, 29 bp, Artificial Sequence
  chemically treated genomic DNA (Homo sapiens)
cgttagtacgtagatgtaattggttttcg

SEQ ID NO: 248 - DNA, 30 bp, Artificial Sequence
  chemically treated genomic DNA (Homo sapiens)
ctcccacacctacaaaccaacactccacaa

SEQ ID NO: 249 - DNA, 28 bp, Artificial Sequence
  chemically treated genomic DNA (Homo sapiens)
tggttattaattatgtttatttttatag

SEQ ID NO: 250 - DNA, 24 bp, Artificial Sequence
  chemically treated genomic DNA (Homo sapiens)
accaaatatctaaatactacaacc

SEQ ID NO: 251 - DNA, 40 bp, Artificial Sequence
  chemically treated genomic DNA (Homo sapiens)
tacaaccacaaactaccaaaacccatattaaacaacacac

SEQ ID NO: 252 - DNA, 25 bp, Artificial Sequence
  chemically treated genomic DNA (Homo sapiens)
tatgcgtttaacgtgtttttttgcg

SEQ ID NO: 253 - DNA, 25 bp, Artificial Sequence
  chemically treated genomic DNA (Homo sapiens)
tggcgggttttacgttttttgtagt

SEQ ID NO: 254 - DNA, 20 bp, Artificial Sequence
  chemically treated genomic DNA (Homo sapiens)
ccaaaacctaaacttacaac

SEQ ID NO: 255 - DNA, 17 bp, Artificial Sequence
  chemically treated genomic DNA (Homo sapiens)
ggaaatttgaggggtaa

SEQ ID NO: 256 - DNA, 31 bp, Artificial Sequence; identical to SEQ ID NO: 104
  chemically treated genomic DNA (Homo sapiens)

SEQ ID NO: 257 - DNA, 17 bp, Artificial Sequence
  chemically treated genomic DNA (Homo sapiens)
ggcgatcgaggcgtcgt

SEQ ID NO: 258 - DNA, 16 bp, Artificial Sequence
  chemically treated genomic DNA (Homo sapiens)
gcgggtggggagcgag

SEQ ID NO: 259 - DNA, 16 bp, Artificial Sequence
  chemically treated genomic DNA (Homo sapiens)
cccaacaaacccacta

SEQ ID NO: 260 - DNA, 20 bp, Artificial Sequence
  chemically treated genomic DNA (Homo sapiens)
gtttagggttaattgtgtga

SEQ ID NO: 261 - DNA, 34 bp, Artificial Sequence
  chemically treated genomic DNA (Homo sapiens)
cactacaccaaacaaaacccctacctccaccaca

SEQ ID NO: 262 - DNA, 20 bp, Artificial Sequence
  chemically treated genomic DNA (Homo sapiens)
cgtagcgtcgggggtttagt

SEQ ID NO: 263 - DNA, 19 bp, Artificial Sequence
  chemically treated genomic DNA (Homo sapiens)
acgtcgttgcgcgtttttg

SEQ ID NO: 264 - DNA, 20 bp, Artificial Sequence
  chemically treated genomic DNA (Homo sapiens)
ccaaaacctaaacttacaac

SEQ ID NO: 265 - DNA, 17 bp, Artificial Sequence
  chemically treated genomic DNA (Homo sapiens)
ggaaatttgaggggtaa

SEQ ID NO: 266 - DNA, 31 bp, Artificial Sequence; identical to SEQ ID NO: 104
  chemically treated genomic DNA (Homo sapiens)

SEQ ID NO: 267 - DNA, 17 bp, Artificial Sequence
  chemically treated genomic DNA (Homo sapiens)
ggcgatcgaggcgtcgt

SEQ ID NO: 268 - DNA, 16 bp, Artificial Sequence
  chemically treated genomic DNA (Homo sapiens)
gcgggtggggagcgag

SEQ ID NO: 269 - DNA, 17 bp, Artificial Sequence
  chemically treated genomic DNA (Homo sapiens)
tttggagaaagagggat

SEQ ID NO: 270 - DNA, 20 bp, Artificial Sequence
  chemically treated genomic DNA (Homo sapiens)
aaaatcaaaaattacacctc

SEQ ID NO: 271 - DNA, 26 bp, Artificial Sequence
  chemically treated genomic DNA (Homo sapiens)
acctcccaccctccactcaacattca

SEQ ID NO: 272 - DNA, 22 bp, Artificial Sequence
  chemically treated genomic DNA (Homo sapiens)
cggaattgtagagcgtcggtta

SEQ ID NO: 273 - DNA, 22 bp, Artificial Sequence
  chemically treated genomic DNA (Homo sapiens)
gttttttttttcgcgaacgtcg

SEQ ID NO: 274 - DNA, 17 bp, Artificial Sequence
  chemically treated genomic DNA (Homo sapiens)
cggttgttgtaggcgtc

SEQ ID NO: 275 - DNA, 18 bp, Artificial Sequence
  chemically treated genomic DNA (Homo sapiens)
gcaaaacacacgaaaacg

SEQ ID NO: 276 - DNA, 20 bp, Artificial Sequence
  chemically treated genomic DNA (Homo sapiens)
cgcgtgtgtaggtcgcgcgt

SEQ ID NO: 277 - DNA, 20 bp, Artificial Sequence
  chemically treated genomic DNA (Homo sapiens)
aaaatcctctccaacacgtc

SEQ ID NO: 278 - DNA, 20 bp, Artificial Sequence
  chemically treated genomic DNA (Homo sapiens)
cgcgattcgttgtttattag

SEQ ID NO: 279 - DNA, 25 bp, Artificial Sequence
  chemically treated genomic DNA (Homo sapiens)
cggatttcgcggttaacgcgtagtt

SEQ ID NO: 280 - DNA, 17 bp, Artificial Sequence
  chemically treated genomic DNA (Homo sapiens)
cggttgttgtaggcgtc

SEQ ID NO: 281 - DNA, 18 bp, Artificial Sequence
  chemically treated genomic DNA (Homo sapiens)
gcaaaacacacgaaaacg

SEQ ID NO: 282 - DNA, 20 bp, Artificial Sequence
  chemically treated genomic DNA (Homo sapiens)
cgcgtgtgtaggtcgcgcgt

SEQ ID NO: 283 - DNA, 20 bp, Artificial Sequence
  chemically treated genomic DNA (Homo sapiens)
aaaatcctctccaacacgtc

SEQ ID NO: 284 - DNA, 20 bp, Artificial Sequence
  chemically treated genomic DNA (Homo sapiens)
cgcgattcgttgtttattag

SEQ ID NO: 285 - DNA, 25 bp, Artificial Sequence
  chemically treated genomic DNA (Homo sapiens)
cggatttcgcggttaacgcgtagtt

SEQ ID NO: 286 - DNA, 25 bp, Artificial Sequence
  chemically treated genomic DNA (Homo sapiens)
gttttttttattagttggaagattt

SEQ ID NO: 287 - DNA, 20 bp, Artificial Sequence
  chemically treated genomic DNA (Homo sapiens)
aaactacaacaaaccttatc

SEQ ID NO: 288 - DNA, 37 bp, Artificial Sequence; identical to SEQ ID NO: 113
  chemically treated genomic DNA (Homo sapiens)

SEQ ID NO: 289 - DNA, 17 bp, Artificial Sequence
  chemically treated genomic DNA (Homo sapiens)
cgtttacggttcgcgcg

SEQ ID NO: 290 - DNA, 20 bp, Artificial Sequence
  chemically treated genomic DNA (Homo sapiens)
cgttcgtttgttttagcgcg

SEQ ID NO: 291 - DNA, 26 bp, Artificial Sequence
  chemically treated genomic DNA (Homo sapiens)
gtagtagttagtttagtatttatttt

SEQ ID NO: 292 - DNA, 17 bp, Artificial Sequence
  chemically treated genomic DNA (Homo sapiens)
cccaccaaccatcatat

SEQ ID NO: 293 - DNA, 32 bp, Artificial Sequence; identical to SEQ ID NO: 54
  chemically treated genomic DNA (Homo sapiens)

SEQ ID NO: 294 - DNA, 25 bp, Artificial Sequence
  chemically treated genomic DNA (Homo sapiens)
gttcgaaatgattttatttagttgc

SEQ ID NO: 295 - DNA, 17 bp, Artificial Sequence
  chemically treated genomic DNA (Homo sapiens)
cgttgatcgcggggttc

SEQ ID NO: 296 - DNA, 17 bp, Artificial Sequence
  chemically treated genomic DNA (Homo sapiens)
ggggagggttgtttatt

SEQ ID NO: 297 - DNA, 17 bp, Artificial Sequence
  chemically treated genomic DNA (Homo sapiens)
cccctccctttaactct

SEQ ID NO: 298 - DNA, 31 bp, Artificial Sequence; identical to SEQ ID NO: 59
  chemically treated genomic DNA (Homo sapiens)

SEQ ID NO: 299 - DNA, 24 bp, Artificial Sequence
  chemically treated genomic DNA (Homo sapiens)
ttagtcggaggtgaggaacgattt

SEQ ID NO: 300 - DNA, 24 bp, Artificial Sequence
  chemically treated genomic DNA (Homo sapiens)
ttatttcgttgtcgggtttaagcg

SEQ ID NO: 301 - DNA, 22 bp, Artificial Sequence
  chemically treated genomic DNA (Homo sapiens)
gtagtagtagtagggtagagag

SEQ ID NO: 302 - DNA, 19 bp, Artificial Sequence
  chemically treated genomic DNA (Homo sapiens)
catccccctacaacctaaa

SEQ ID NO: 303 - DNA, 35 bp, Artificial Sequence; identical to SEQ ID NO: 67
  chemically treated genomic DNA (Homo sapiens)

SEQ ID NO: 304 - DNA, 16 bp, Artificial Sequence
  chemically treated genomic DNA (Homo sapiens)
cgcgggagagggcgtt

SEQ ID NO: 305 - DNA, 19 bp, Artificial Sequence
  chemically treated genomic DNA (Homo sapiens)
tgttggcgatcggcgtttt

SEQ ID NO: 306 - DNA, 17 bp, Artificial Sequence
  chemically treated genomic DNA (Homo sapiens)
gcggtttcggagtggtt

SEQ ID NO: 307 - DNA, 19 bp, Artificial Sequence
  chemically treated genomic DNA (Homo sapiens)
cctcccgaacctaaaacga

SEQ ID NO: 308 - DNA, 18 bp, Artificial Sequence
  chemically treated genomic DNA (Homo sapiens)
acgcccgacgaacgccaa

SEQ ID NO: 309 - DNA, 24 bp, Artificial Sequence
  chemically treated genomic DNA (Homo sapiens)
tttatgtttttcgtttttcgttcg

SEQ ID NO: 310 - DNA, 21 bp, Artificial Sequence
  chemically treated genomic DNA (Homo sapiens)
gaatcctcacacctccaaccg

SEQ ID NO: 311 - DNA, 24 bp, Artificial Sequence
  chemically treated genomic DNA (Homo sapiens)
cgcccactacaccgcaaacaaatc

SEQ ID NO: 312 - DNA, 18 bp, Artificial Sequence
  chemically treated genomic DNA (Homo sapiens)
ttacgtgtgaggggttcg

SEQ ID NO: 313 - DNA, 22 bp, Artificial Sequence
  chemically treated genomic DNA (Homo sapiens)
acgaaaatccaccaatcgaaac

SEQ ID NO: 314 - DNA, 29 bp, Artificial Sequence
  chemically treated genomic DNA (Homo sapiens)
tccaaatacgataaccgatacccgaaacg

SEQ ID NO: 315 - DNA, 23 bp, Artificial Sequence
  chemically treated genomic DNA (Homo sapiens)
ggtattaggtcggtatttttcgt

SEQ ID NO: 316 - DNA, 23 bp, Artificial Sequence
  chemically treated genomic DNA (Homo sapiens)
ctattaaaaacacgcgacatcga

SEQ ID NO: 317 - DNA, 23 bp, Artificial Sequence
  chemically treated genomic DNA (Homo sapiens)
tcgttttcgcggttgttcgttgt

SEQ ID NO: 318 - DNA, 25 bp, Artificial Sequence
  chemically treated genomic DNA (Homo sapiens)
ttcggaatcggaagttcgttgtttg

SEQ ID NO: 319 - DNA, 17 bp, Artificial Sequence
  chemically treated genomic DNA (Homo sapiens)
gcgatttcgacgtcggt

SEQ ID NO: 320 - DNA, 19 bp, Artificial Sequence
  chemically treated genomic DNA (Homo sapiens)
ctacgttctccgcctcgtt

SEQ ID NO: 321 - DNA, 27 bp, Artificial Sequence
  chemically treated genomic DNA (Homo sapiens)
agggtcgtatttaggttgtcgtcgtta

SEQ ID NO: 322 - DNA, 26 bp, Artificial Sequence
  chemically treated genomic DNA (Homo sapiens)
tagtcgcgaaaagaggttggagtaag

SEQ ID NO: 323 - DNA, 16 bp, Artificial Sequence
  chemically treated genomic DNA (Homo sapiens)
gggtttcgggcgggta

SEQ ID NO: 324 - DNA, 21 bp, Artificial Sequence
  chemically treated genomic DNA (Homo sapiens)
atatcgcactcgctatcgcta

SEQ ID NO: 325 - DNA, 23 bp, Artificial Sequence
  chemically treated genomic DNA (Homo sapiens)
gagggcgacggtacgttagaggt

SEQ ID NO: 326 - DNA, 24 bp, Artificial Sequence
  chemically treated genomic DNA (Homo sapiens)
ttgggcgtcgttattagttcggtc

SEQ ID NO: 327 - DNA, 19 bp, Artificial Sequence
  chemically treated genomic DNA (Homo sapiens)
gtcgggttggagggacgta

SEQ ID NO: 328 - DNA, 21 bp, Artificial Sequence
  chemically treated genomic DNA (Homo sapiens)
atatcgcactcgctatcgcta

SEQ ID NO: 329 - DNA, 23 bp, Artificial Sequence
  chemically treated genomic DNA (Homo sapiens)
gagggcgacggtacgttagaggt

SEQ ID NO: 330 - DNA, 24 bp, Artificial Sequence
  chemically treated genomic DNA (Homo sapiens)
ttgggcgtcgttattagttcggtc

SEQ ID NO: 331 - DNA, 25 bp, Artificial Sequence
  chemically treated genomic DNA (Homo sapiens)
gttttttttattagttggaagattt

SEQ ID NO: 332 - DNA, 20 bp, Artificial Sequence
  chemically treated genomic DNA (Homo sapiens)
aaactacaacaaaccttatc

SEQ ID NO: 333 - DNA, 37 bp, Artificial Sequence; identical to SEQ ID NO: 113
  chemically treated genomic DNA (Homo sapiens)

SEQ ID NO: 334 - DNA, 17 bp, Artificial Sequence
  chemically treated genomic DNA (Homo sapiens)
cgtttacggttcgcgcg

SEQ ID NO: 335 - DNA, 20 bp, Artificial Sequence
  chemically treated genomic DNA (Homo sapiens)
cgttcgtttgttttagcgcg

SEQ ID NO: 336 - DNA, 21 bp, Artificial Sequence
  chemically treated genomic DNA (Homo sapiens)
gaggtgttagaggagtagtag

SEQ ID NO: 337 - DNA, 17 bp, Artificial Sequence
  chemically treated genomic DNA (Homo sapiens)
tccccctacaacctaaa

SEQ ID NO: 338 - DNA, 37 bp, Artificial Sequence; identical to SEQ ID NO: 80
  chemically treated genomic DNA (Homo sapiens)

SEQ ID NO: 339 - DNA, 15 bp, Artificial Sequence
  chemically treated genomic DNA (Homo sapiens)
cgagtcggcgcggga

SEQ ID NO: 340 - DNA, 20 bp, Artificial Sequence
  chemically treated genomic DNA (Homo sapiens)
agggcgttttgttggcgatc

SEQ ID NO: 341 - DNA, 25 bp, Artificial Sequence
  chemically treated genomic DNA (Homo sapiens)
aaaaaaaaaaaactcctctacatac

SEQ ID NO: 342 - DNA, 24 bp, Artificial Sequence
  chemically treated genomic DNA (Homo sapiens)
ggttattgtttgggttaataaatg

SEQ ID NO: 343 - DNA, 38 bp, Artificial Sequence; identical to SEQ ID NO: 85
  chemically treated genomic DNA (Homo sapiens)

SEQ ID NO: 344 - DNA, 21 bp, Artificial Sequence
  chemically treated genomic DNA (Homo sapiens)
ttttttttttcggacgtcgtt

SEQ ID NO: 345 - DNA, 20 bp, Artificial Sequence
  chemically treated genomic DNA (Homo sapiens)
tcggtcgatgttttcggtaa

SEQ ID NO: 346 - DNA, 20 bp, Artificial Sequence
  chemically treated genomic DNA (Homo sapiens)
tgagagagagagggttgaaa

SEQ ID NO: 347 - DNA, 24 bp, Artificial Sequence
  chemically treated genomic DNA (Homo sapiens)
tctaaataacaaaatacctccatt

SEQ ID NO: 348 - DNA, 27 bp, Artificial Sequence
  chemically treated genomic DNA (Homo sapiens)
ccattaccaacacaacccaccaaccaa

SEQ ID NO: 349 - DNA, 16 bp, Artificial Sequence
  chemically treated genomic DNA (Homo sapiens)
cgacccgccaaccgac

SEQ ID NO: 350 - DNA, 15 bp, Artificial Sequence
  chemically treated genomic DNA (Homo sapiens)
cgccgaaacgcgctc

SEQ ID NO: 351 - DNA, 28 bp, Artificial Sequence
  chemically treated genomic DNA (Homo sapiens)
tggttattaattatgtttatttttatag

SEQ ID NO: 352 - DNA, 24 bp, Artificial Sequence
  chemically treated genomic DNA (Homo sapiens)
accaaatatctaaatactacaacc

SEQ ID NO: 353 - DNA, 40 bp, Artificial Sequence; identical to SEQ ID NO: 251
  chemically treated genomic DNA (Homo sapiens)

SEQ ID NO: 354 - DNA, 25 bp, Artificial Sequence
  chemically treated genomic DNA (Homo sapiens)
tatgcgtttaacgtgtttttttgcg

SEQ ID NO: 355 - DNA, 25 bp, Artificial Sequence
  chemically treated genomic DNA (Homo sapiens)
tggcgggttttacgttttttgtagt

SEQ ID NO: 356 - DNA, 26 bp, Artificial Sequence
  chemically treated genomic DNA (Homo sapiens)
gtagtagttagtttagtatttatttt

SEQ ID NO: 357 - DNA, 17 bp, Artificial Sequence
  chemically treated genomic DNA (Homo sapiens)
cccaccaaccatcatat

SEQ ID NO: 358 - DNA, 32 bp, Artificial Sequence; identical to SEQ ID NO: 54
  chemically treated genomic DNA (Homo sapiens)

SEQ ID NO: 359 - DNA, 19 bp, Artificial Sequence
  chemically treated genomic DNA (Homo sapiens)
gaaccccgcgatcaacgcg

SEQ ID NO: 360 - DNA, 26 bp, Artificial Sequence
  chemically treated genomic DNA (Homo sapiens)
gtagtagttagtttagtatttatttt

SEQ ID NO: 361 - DNA, 17 bp, Artificial Sequence
  chemically treated genomic DNA (Homo sapiens)
cccaccaaccatcatat

SEQ ID NO: 362 - DNA, 32 bp, Artificial Sequence; identical to SEQ ID NO: 54
  chemically treated genomic DNA (Homo sapiens)

SEQ ID NO: 363 - DNA, 25 bp, Artificial Sequence
  chemically treated genomic DNA (Homo sapiens)
gttcgaaatgattttatttagttgc

SEQ ID NO: 364 - DNA, 17 bp, Artificial Sequence
  chemically treated genomic DNA (Homo sapiens)
cgttgatcgcggggttc

SEQ ID NO: 365 - DNA, 20 bp, Artificial Sequence
  chemically treated genomic DNA (Homo sapiens)
ccaaaacctaaacttacaac

SEQ ID NO: 366 - DNA, 17 bp, Artificial Sequence
  chemically treated genomic DNA (Homo sapiens)
ggaaatttgaggggtaa

SEQ ID NO: 367 - DNA, 31 bp, Artificial Sequence; identical to SEQ ID NO: 104
  chemically treated genomic DNA (Homo sapiens)

SEQ ID NO: 368 - DNA, 19 bp, Artificial Sequence
  chemically treated genomic DNA (Homo sapiens)
gttaattgcgggcgatcga

SEQ ID NO: 369 - DNA, 17 bp, Artificial Sequence
  chemically treated genomic DNA (Homo sapiens)
cgtcgttagcgggtggg

SEQ ID NO: 370 - DNA, 17 bp, Artificial Sequence
  chemically treated genomic DNA (Homo sapiens)
cggttgttgtaggcgtc

SEQ ID NO: 371 - DNA, 18 bp, Artificial Sequence
  chemically treated genomic DNA (Homo sapiens)
gcaaaacacacgaaaacg

SEQ ID NO: 372 - DNA, 20 bp, Artificial Sequence
  chemically treated genomic DNA (Homo sapiens)
cgcgtgtgtaggtcgcgcgt

SEQ ID NO: 373 - DNA, 20 bp, Artificial Sequence
  chemically treated genomic DNA (Homo sapiens)
aaaatcctctccaacacgtc

SEQ ID NO: 374 - DNA, 20 bp, Artificial Sequence
  chemically treated genomic DNA (Homo sapiens)
cgcgattcgttgtttattag

SEQ ID NO: 375 - DNA, 25 bp, Artificial Sequence
  chemically treated genomic DNA (Homo sapiens)
cggatttcgcggttaacgcgtagtt

SEQ ID NO: 376 - DNA, 6887 bp, Homo Sapiens
cgccgcccgtgggccgccggccggccgcagctcgctggcgacgagggcactacagttgctctgaccgcgtagattatgcatgtcccggcctcgggaatttaccatgcattagaatacattagcgcctgcattttaaaaggctaaactattggctcccagctagggactctcggtaagtggcttgttagtgacgagtgtttgtctatactggcacatagcggagtcttttgctcccggcttactcgcctccaggaaagctttggggtgaggcgaaggcgattgaagcaatgccccttcccccagatcgcagctgctcaggggggacacagcacggcatctttcaccgaatctctctcgctcgctcgcactccagcctccctctccccagcgacccccccaccttctcctccctccctctccttgacgtttgattccagtagcaaaggaggtaaaaaaggcaccgagccgtcagccaaacctgaaaagtgcggccccgccccctccacagccactggtagcttcccgtggaaggcccgcctcccggggcagctgcggcctcggagtggttgcgcttggcgcccgtcgggcgtggccccgccccaggtccgggagggtaggttggctgccccggcgagcggcagagcccttctggacagctcccgctcacccaaacagaagacgtcggcgccggagcgggctcggacatggcgaggctgcgagccggcccgagcggcggggcccggtgatccctccctccctccccgtcccctcccctctcccgcacgcacgccccgtccgcccccaccccgcccccaccccgggcgagcccgcccgcagcccggggcgcacacccgcacgcgcactcctctccactcactcccgcgcccgcccccactcccgcagccgagccccgccacgcgcgccttgcccgcccgccggccgcccccgccgcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctgggcggctgggtccgcgaagccaatgcgctgaacggtgcccg

SEQ ID NO: 377 - DNA, 2494 bp, Homo Sapiens
tttctatgaagttacaaagctgcaatcccgttctcatgtgcagcaccacaggttttgctttcaaatatctgcaggtgcatcctcctgcactcgttaaactaagggttttccttttctgtgctagacccgcttttacgaccacgctctccacctgattcacagaaagggttctacgaccgtcaggtcaccgccgcctttgtactttattggggagtcgaaggcctcagcgctgctcgcgatttccctaaggtggtcgggaaggtcccaaccacgttcttctgtaaaccagataaggaaggcctggggattccggccgcggaaaggcacagaggaggtgaacgctccggatgcccaagtgacgcacttgtaggcggattcggaaactcgtgctcttgagccggaggcggagcccccagactcagaccgaccccccagaaccgggcggccttgcccgaggcatgaaggctttctaggcccgcttctaaaagctgtgtacaatggagactcctggaataggcacatatctctactgtaatcagaacgagatgtaacatctaagacgcagggcagggctctggcaaagacacgctgggggaacgtgaaagaaagggccaaaactacgcagctggtcctcagagaccaaagactacgacccccagcattcaatgcagtgaacccctaggacgttgcatgccgggagctgtagtttctcaccaccgccacccccccgcccccccgccatctgaaagggttctaggggatttgcaacctctctcgtgtgtttcttctttccgagaagcgccgccacacgagaaagctggccgcgaaagtcgtgctggaatcacttccaacgaaaccccaggcatagatgggaaagggtgaagaacacgttgccatggctaccgtttccccggtcacggaataaacgctctctaggatccggaagtagttccgccgcgacctctctaaaaggatggatgtgttctctgcttacattcattggacgttttcccttagaggccaaggccgcccaggcaaaggggcggtcccacgtgtgaggggcccgcggagccatttgattggagaaaagctgcaaaccctgaccaatcggaaggagccacgcttcgggcatcggtcaccgcacctggacagctccgattggtggacttccgcccccctcacgaatcctcattgggtgccgtgggtgcgtggtgcggcgcgattggtgggttcatgtttcccgtcccccgcccgcgagaagtgggggtgaaaagcggcccgacctgcttggggtgtagtgggcggaccgcgcggctggaggtgtgaggatccgaacccaggggtggaggcggctcctgcgatcgaaggggacttgagactcaccggccgcacgccatgagggccctgtgggtgctgggcctctgctgcgtcctgctgaccttcggtgagtgattctggaggagcagacgtcccccctccacacacgcggccgcttctcgaaggtcctgggggcgttgaacgtgggaggggggatcccggggcctgcggtgggccaagggacgtcaccattcctcgaaagagggcaagggaattacgtttattctcttcttcctctggaaataaaaaaagagagcaacatcatctaactgccctacagatctaatagtatctcgcccggaggtctcagcgacctcggggtggggcctctctgaggctctggctcccccgggagctgtgcgagcccctcccccctccccgcccggaggactttttcggccaccgcaaccttcggccatcccagctttcccgtcccctaattccccagactccgactcctcgcaagcccgtgtcccttcttagatgctggcctcgggagcgtgaggcctggggccagcggaatggcagtgtcagcgtgtttgattcagttttgctggagttcggttcttaacatttctcccccttctcatgcctctgggctcaatttcagttcccctcgccagaggttgcataaatcctatttgcattctgacctgtgctaacgaaggccgaagttttggcttgatcagttgggaggccttggctcggcctgcgcgcaacacgtgtgggtgtagaagaggcctggtatcagtctgcttaacgttatttataaatgatcggagacacactgtttagaagtggtgactgcctccgtatttcaggatctactggagacctcagcatctgaacttaaatagatgttctgtcttggctttacctttggtatttaaaccagggaatgcactctttcatccccacctcccttagttaccaactgaattttgcaacccctacccttccctatttgatcatcctccttggagaagtgtgatgttgaagagtttgcccgtgttaaatcttcagggtcggtcagagctgacgatgaagttgatgtggatggtacagtagaagaggatctgggtaaaagtagagaaggatcaaggacggatgatgaagt

SEQ ID NO: 378 - DNA, 2476 bp, Homo Sapiens
aattactaggaggctgggggaaaagaggggaaaaacgggtaaggaaggttgcaaatgttaagatgccaaacaggaacccaaccgaagtccgaagtgaaatacagcctcctctggcccaactgtcatgcaaacaacttctaagcatcttcagatgtaaagaaaaacagtcattgtgcacaggcgttagctgaatgttcgagagttggatgaatggggaagacttgttatacacctagtggtgggtggatttcactaggctgcagcctccacacagcttttctttgctgcactgcagaggcgccatcttctccgtcttaatcttcactcaattcgatccttttatctgcaccctaaaaaaaagacccttcggaccctccccagcatcctgtgcccccaggggaactaaaccagagtccccagagctgccagggaagaggccgcgccttaatcagacaaacgcctccttggatgcacaggacagagcccgtgcctccccaccatccgccactgccctttccagacgcacatcccactctccgccttatttcctccccgccaaggactttacagcccagcacagaattaagcctcggaggtgatccgagggtgggaagcagaggggccccgaggctccgccagaagccccggcagcgtctctgccccctcccaggcggacgcgcagccccgggaagggagccgggcgggagcctcggtggcgcactgagactaacgcggctcggcccacggcgagggcggggtgtcgcggcttttgttcccgcggaccttctgcctctcagacagagcttagggtgcgagcgaactcccgggacgtccagacttggggaaggcgcggggtggctatgggtctccgacccctcccatttctcgcaagttacacaaaagggagacgcggacatgcacaaagtttgcctgtggaaggcggtgcgcgaccccgacgccggctcgggctagggtcgcacccaggctgccgccgccagcagccgcgaaaagaggttggagcaaggaagggggatgggggtgagagaggaaggtgaaacgaggcggagaacgcagggaaaagcgaggggctcctagcttcctgggctgtcccgactcctcctcctcctccccagggcccaagagaaaggaaagggcaacgattcaagagcgaaggactggctttagggacgctgcgttttcggttttccccacgtgctccttcccccttcccccctgtctgaatgtctctcgcctcccccgacccccgcttccaaggcagggactaagtcggggtctgggctcagggtcgccccctacccttctcgccccgggctggcgcggaaccagggagaccagcgcctcgcccgctccctctcagcgggccggagcgcgactccctggggcagggctgggccgaaagcggggatgcgctggacgtccgcaagcgggggcggagaggagaggggtcccattgacggacccccggcttctctgcattaaagacttgggttaaggtcttggggggtatcgcgtccccaccgtgcagcctccccccgccttccgaggcgcggcacccacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatccggcccaccccgctcggcacccgagagagacccctagcggcgccgccggggaactgcgcccgctcgcgccgggaggggccctcgcgccccgcgcccacaggtgcacgcgcccttggcgccgcctgcaccccacgcgccccctccgctccccggccgacggcccacctgggcttcgtgaacagtgggagggagagtctggggccaggagagggacggtgcaggatcagggaaaggtgagtcctaggacgctgaggctctagaaaagtcgagagcgctcctgctcgtccccgtgagcttgaatcatccgaccccgcaggcctcccgggggtgtcgtataaaggactgctgctagggtgcgtttttatccgcatttcgttttttctctcggtttggagaggtggggcaggcgtttctggaagagaatgagaacgagtgaagcttaaaggaaataggattttctttgcttgttgagacagcaaaacctcattttttaacccccaacgtcaaaagcaggcacgagcaacctggaatttctatctttagaacgaaccaaaggagcaaggcgcaggacctggcaaagaagcggccaacccatttacttcttcttgaaagcagggttctgggcttgggttttgtttcttt

SEQ ID NO: 379 - DNA, 6887 bp, Artificial Sequence
  chemically treated genomic DNA (Homo sapiens)
cgtcgttcgtgggtcgtcggtcggtcgtagttcgttggcgacgagggtattatagttgttttgatcgcgtagattatgtatgtttcggtttcgggaatttattatgtattagaatatattagcgtttgtattttaaaaggttaaattattggtttttagttagggattttcggtaagtggtttgttagtgacgagtgtttgtttatattggtatatagcggagttttttgttttcggtttattcgtttttaggaaagttttggggtgaggcgaaggcgattgaagtaatgtttttttttttagatcgtagttgtttaggggggatatagtacggtattttttatcgaatttttttcgttcgttcgtattttagtttttttttttttagcgatttttttatttttttttttttttttttttttgacgtttgattttagtagtaaaggaggtaaaaaaggtatcgagtcgttagttaaatttgaaaagtgcggtttcgttttttttatagttattggtagtttttcgtggaaggttcgtttttcggggtagttgcggtttcggagtggttgcgtttggcgttcgtcgggcgtggtttcgttttaggttcgggagggtaggttggttgtttcggcgagcggtagagtttttttggatagttttcgtttatttaaatagaagacgtcggcgtcggagcgggttcggatatggcgaggttgcgagtcggttcgagcggcggggttcggtgattttttttttttttttcgtttttttttttttttcgtacgtacgtttcgttcgtttttatttcgtttttatttcgggcgagttcgttcgtagttcggggcgtatattcgtacgcgtatttttttttatttattttcgcgttcgtttttattttcgtagtcgagtttcgttacgcgcgttttgttcgttcgtcggtcgttttcgtcgttttcgtcgttttcgggttttgatggattgaatgaaggttgtttatatcgtttatcgatgttttattaaagatttagaaggttgcgttatgaattcggagttgataatggaaagtttgggtattttgtacgggtcggtcggcggcggtagtggcgggggcggcggcgggggcggcgggggcggcggcgggggttcgggttatgagtaggagttgttggttagttttagtttttattacgcgggtcgcggcgtcgttggttcgttgcggggtttttcgtcgtttttaatcgcgtattaggagttgggtacggcggtagcggcggtagcggcggcgtcgcgttcggttatggttattagtatggtttcgattttggacggcggcgattatcggttcgagttttttatttcgttgtattacgttatgagtatgttttgcgattcgttttcgtttggtatgggtatgagtaatatttatattacgttgatatcgttttagtcgttgttatttatttttatcgtgtttgataagttttattatttttattcgtattattattcgtattattattattattattattattagcgtttgttcggtaacgttagcggtagttttatttttatgcgcgacgagcgcgggttttcggttatgaataatttttatagtttttataaggagatgttcggtatgagttagagtttgttttcgttggtcgttacgtcgttgggtaacgggttaggcggtttttataacgcgtagtagagtttgtttaattacggttcgtcgggttacgataaaatgtttagttttaatttcgacgcgtattatattgttatgttgattcgcggtgagtaatatttgtttcgcggtttgggtattttatttgcggttatgatgtcgtatttgaacggtttgtattattcgggttatatttagttttacgggtcggtgttggtatttagtcgcgagcggttattttcgtttttatcgggttcgtaggtggttacgtcgggttagttggaagaaattaatattaaagaggtggtttagcgtattatagcggagttgaagcgttatagtattttttaggcgatttttgcgtagagggtgttgtgtcggttttaggggatttttttcgatttgtttcggaatttaaaatcgtggagtaaatttaaatttggtagggagatttttcgtaggatgtggaagtggttttaggagttcgagttttagcgtatgttcgttttacgtttggtaggtaaggtcggggttagttaggggttaggttgttgggaagagggtttcgggttcggtgtttgtggtttaagtttgcgcgtcgagttattttttttgatttttttttttttttttttatatacgtttttttttttttcgtttttatttttttttttattttttttttttttttcgttttttttttatttttttttttttttttttttttttttttttattttttttttgtttttgagtttttattgatcgatttttttttattttattcgttttttttttaatgtgttaatttttgttttattttcgatttttttaggtattgggaggcgggatgggggtgtgcgtttttttttaggagttttgtttttttaagatttatagaaattaggatttgtttttatttaaaattttatgtattttaagttttttttagataatatattttaatttttcgggttgattagtttttttgtgtagaggtagttgagaggttttgttttgtagagggaaaagagttttttatttttttatttattatataggtaaatttatttggttattggttgaaggtatagttttgttttcgcggggaatcggcggttaggatataatagcgtttttggagtttatttttggttttggcgttggcgtagggattttttgatcgggtttgaggggttcgggttagttttaatgttattatttatagcgagggtagggtgtaaggttgagaaggttatatttatcgttttgggaggacgtgggagaagagattgaggtggaaagcgttttgttttgtttatcggtcgtttttgtttcggttttagcgtttgttgggatttgttaggatttgtcggggtttcgggagattttgagtattcgtaggaagaggtgttgagaaattaaaaatttaggttagttaatgtatttttgtcgtcggttgtaggtttcgtttttgtattaagcgggcgttgattgtgcgcgtttggcgatcgcggggaggattggcggttcgcgggaggggacgggtagaggcgcgggttatattgttttggagtcggttcggttttttgtgttttttttagcggttaagttgcgaggtatagttttttattgttttaggagtatagaaattttttgtgtgggcggcgggtgcgcgagttagagggaaagatgtagtagttattgcgattggtacgtagttgcgcgtttttgtgcgtacggatttcgcgcggtgtgcgtggcgattgcgttgtttttaggagtaagttacgggtttagaggggtaaaatgtttaggtttttcgttgggaaggatatattatattttatggtaagttagggtgggcgattttttatggatcgggtggaggggggtattttttaggatcggcgggcggtttaggggaataattcgtggtggcgatgatttgtatagcgcgggttttgggatgcgcgcggtttcgagttagtttcgtatagttcgttttcggagttgcgagtttaggtttttattttcgatttttcgggtttttttcgtatcgttgagtttagtttgtggggtgtattcgattaacgttcgatagggttggggaatgtgataggtagtaggtttattcgggtttggggagggggagttttcgttttgatagtatttttttttgtcgtttgttggtggatttttatttttagtcggtaatcgtttcgtagtgttgatttaagaaggtaaagaaaattaggtttttttgtaaagagttttttttaaatcggcggatttcggatattttgagtggatttagaaatttatgtaattttttttttttagtttattttttatttttttttatagttttttttgatttgttgttggttcggggtaagataaagtagttagtagagagcgataataatagcggcgggaaatgaattggagattggttgatagtttttaatattttgttatagattttttcgaatgttttaggttgtttttggtgggttttagtattcgtcggttttttgggtatcggggattagaaggaatttggtagttggttttaggggtatagttaaaggtaggatgatagttatttttttgtttattttagagcgttgtcgtttttttatgtcggtcgcgtaaagaatatagtttttaaaaaatacgtgttttttgtttatataggtttgaaagtgatgaggaaagtaatgtttcgtttattagcgagttttagtttttaaaatgattttaagcgttgttgagatgagaaagcgtggtatttcgggggtttttagttttattcgcgtttatggtgtaagtttgtagggataggttcgggatagtattgtttacgttgttagatttttcgtagaggatcgttgaagttgttttcgtgggagatagaatgttttttttagcgagtggaaaaggtttgttgaggatttcgttttgttcgagtatttaaatgtgtgtttgttttattattttgggttgaaaagggataagagttttagtttttttatttggttattttattagtaattataagtgtgttgagtggttattattatataggaggttttttagtttggggttagtagattagtttttttagatattgatgtagaagttgggattggtaagtaggtattatgtgttcggagcgttaggggataggagtaaatggagaagaaaagcggaggtttttttcgttcggagtatcgatcggaattttcgtcggtacgtcgtagagggttttcgtcgttgggtttcgggggtttaataagtttagtcgtttcgtaggcggttcggtcggatttttagatcggtgtttggaagatatcgtttttgtttttttttcgttaaatttgtttttttttttttttttataggttataggtttttttttttttttattttggtttcgttttcgggttttgttaaatagttaagtaggtcggggtttagggggtttagaatgaagaggtttgatttggttagcgtcggtaaagtttatttttaggcgaggttataatagaggtaggttttttttgtttagtttgtcggtgtagttatagttaagggtggtatttgaaaggaaaagggagaaaatttcggagaaatttagattgttttaacgttagattttagagaaattgattttaaatgtacggattcgttcggaaagggcggttaagtggtaggtggttgtaatttcgttcggtcgggttttcgtagaggttttttaagattagtttttgtagggcggtttttagtaatttgataagaggcggttaagataaatttttgcgggttcgagtatatattttcgggcgttgggttttagagatttttaaattaagtataaataagaagggagtgagagaatttaggttagaatttgtacgggtattttattgaggaaaagcgaggtttcggtggtaggtatgttttttttcgacgttcgaaaatcgagtcgagcgttcgattatatttattgtagaggttttcgtttttagtgagttcggattttttagcggtttgttcggagttggtttttagttttcgtcgtagttcgacgtacggtttttttttggtagtaagtttttagcggttagtttgaagttaattttgtttaggcggtcgagggtttttagttaatttattatgatgtcgtttgggttatttgatgttcgtagcggcgggatacggttcgggtagtgcgtagtggtttttgttaggggtatcgcgtgcgtgtttgtttttcgttgcgtcggggacgtttttgggtgatacgggtcgttgggtattttttaagtcgaggaaacggatttttttcgtagagtttcgcgtttattttttaattttttatttcgtttttcgttgttagggttttcgatttagtttattttttttggcggtttagttagggattagagttggagaggttgaacgtaattcgtgttagtacggaatagacgatatgtttgtttgttagttgtttggatgaataattgaaaagttcgttgtagtttgtgtttcgttaagtttcgggtgtcgggagaatatttttttaatacgtattagggtgggcgggagcgggtagaggaggcgggattcgagggaggagagtgaattcgagtaggagaagtagtttaggtagttaggcgttttcgatgcgagaggttgggtatttatttttattttaggttttttattgtgtggttatgttatttttttaaataaatgtgtatatggagggagatcgatgttgataatgtttagaagattaaaagagtattaatgttggtaataataacgtaaacgtgtggatttagattttattgatttggaatttgattcggcgcgtttttagtaagttcgacggcgcgttttttttagtagagcgtttattagcgttacggtttcgcggttttttagcggtgtcgtttcgttagttttgcgcgggttttttcgtttgatcgtagtttttttttcgcgaggttttagttcgttttattttttcgaggttttttttttttttcgcggggttttttgttttttgtattttttttttcgatttttgtattattcgtttttgtgcgtatatatcgttatttgcgttttcggcgattcgtttgggcggttgggttcgcgaagttaatgcgttgaacggtgttcg

SEQ ID NO: 380 - DNA, 6887 bp, Artificial Sequence
  chemically treated genomic DNA (Homo sapiens)
cgggtatcgtttagcgtattggtttcgcggatttagtcgtttaggcggatcgtcggaagcgtaagtagcggtgtgtgcgtataggggcgggtggtgtagaggtcgggggagggggtgtagagggtagagagtttcgcgagaggaggagaaaatttcggggaagtaaggcgggttggggtttcgcgggggaggagttgcggttagacgggagaattcgcgtagagttggcgaagcggtatcgttggaaaatcgcggggtcgtggcgttggtgagcgttttgttgggaagagcgcgtcgtcgggtttattggaaacgcgtcggattaagttttagattaatgaaatttgggtttatacgtttacgttattgttgttagtattaatgtttttttaattttttaaatattattagtatcgatttttttttatatatatatttgtttgagaaagtgatataattatatagtggaaagtttggaataaaaataaatgtttagtttttcgtatcgagggcgtttggttgtttgggttgttttttttgttcgggtttatttttttttttcgggtttcgttttttttgttcgttttcgtttattttgatgcgtgttgggaaggtgttttttcggtattcgggatttgacgaagtatagattgtagcgaattttttaattatttatttaagtagttagtaggtaaatatatcgtttgtttcgtattggtacgggttgcgtttagtttttttagttttgatttttaattaaatcgttaggagaggtgggttgagtcgggagttttagtagcgagaaacgaggtgggaggttggggggtgggcgcgagattttgcgaagggggttcgttttttcggtttgggaggtgtttagcggttcgtgttatttaaggacgttttcggcgtagcgggagataagtacgtacgcggtgtttttagtaggagttattgcgtattgttcgggtcgtgtttcgtcgttgcgggtattaggtggtttaggcgatattatggtgggttggttaagggttttcggtcgtttgaatagaattggttttagattggtcgttgggagtttgttgttaggagagggtcgtgcgtcggattacggcggggattggagattagtttcgggtaggtcgttgggggattcgggtttattggaggcggaaatttttgtagtaaatgtagtcgggcgttcggttcgattttcgggcgtcggaagaaaatatgtttgttatcgaggtttcgtttttttttagtgggatgttcgtgtaagttttagtttgggtttttttattttttttttgtttgtgtttggtttagaggtttttggggtttaacgttcgagagtgtgtgttcgaattcgtagaaatttgttttggtcgttttttgttaggttgttgaaaatcgttttgtaagggttggttttggggaatttttgcgaaggttcgatcgggcggggttgtaattatttgttatttagtcgtttttttcgaacgaattcgtgtatttggagttaatttttttgaaatttaacgttggggtaatttaaattttttcgaagtttttttttttttttttttaagtgttatttttggttgtgattatatcggtaggttgggtaggaaggatttgtttttgttgtgatttcgtttaagggtgagttttgtcggcgttggttaaattagatttttttattttgagttttttaaatttcggtttgtttggttgtttggtaggattcgggggcggggttaaaatgagagagaaagggaatttataatttatgagagaaagagaagaggtaggtttggcgggaggggggtagggacggtgttttttaggtatcggtttgagagttcggtcgagtcgtttgcggagcggttgggtttgttaaattttcggggtttaacggcgagggttttttgcggcgtatcggcggggatttcgatcgatatttcgggcggagaaagttttcgttttttttttttatttgtttttgttttttagcgtttcgagtatataatatttatttattagttttagtttttgtattagtgtttgaagagattgatttattgattttaaattgaaaagttttttatgtaataataattatttaatatatttgtagttgttgataaaatggttagataaaaaggttaaagtttttgtttttttttaatttagggtaataaaatagatatatatttgaatgttcgagtaaagcggggtttttagtaggttttttttattcgttggaggaggtattttgttttttacgaaggtagttttagcgattttttgcggaaaatttagtagcgtgggtagtgttgtttcgggtttgtttttgtagatttgtattatgggcgcgggtggggttgaggattttcgggatgttacgtttttttattttagtaacgtttgggattattttaaaagttgaaattcgttaataggcgaagtattattttttttattatttttagatttatatgggtagaaggtacgtgttttttaaaagttgtgttttttgcgcgatcggtatgagggggcggtagcgttttgagatgagtaggagaatagttgttattttgtttttaattgtatttttaagattagttgttaagttttttttggttttcggtgtttaagaagtcggcgggtattaaaatttattagagatagtttgggatattcggggggatttatgataaaatgttaagaattgttagttagtttttagtttatttttcgtcgttattattatcgttttttattggttgttttattttgtttcgaattaatagtaaattagagaaaattgtaggagaggatgaaaaataaattaaaggagaaagattatataaatttttaaatttatttaaagtattcggagttcgtcgatttgggggaggttttttgtagggaaatttagttttttttatttttttagattaatattgcggggcgattatcgattgggaataggaatttattagtagacggtaaaggaaaatgttgttaaagcggaaattttttttttttaagttcgggtgaatttgttgtttgttatattttttagttttgtcgggcgttggtcgagtgtattttataagttgggtttagcggtgcgaggaaagttcgggggatcgggggtggaaatttgagttcgtagtttcggaagcgagttgtgcgaggttggttcggaatcgcgcgtattttaagattcgcgttatgtaaattatcgttattacgaattgtttttttagatcgttcgtcgattttgaaagatatttttttttattcgatttatgggaagtcgtttattttggtttgttatagggtatagtgtgttttttttagcgggggatttggatattttgtttttttgggttcgtggtttgtttttaggggtagcgtagtcgttacgtatatcgcgcggggttcgtgcgtataaaagcgcgtaattgcgtgttagtcgtagtaattattgtatttttttttttagttcgcgtattcgtcgtttatataggaggtttttgtgtttttagaataatagagggttgtatttcgtagtttggtcgttagaggaggtataaagagtcgagtcggttttagaataatgtaattcgcgtttttattcgttttttttcgcgggtcgttagtttttttcgcggtcgttaggcgcgtataattagcgttcgtttaatgtaaaggcggagtttgtagtcggcggtagggatgtattaattaatttgaatttttaattttttagtatttttttttgcgagtgtttagggtttttcggagtttcggtaaattttggtaaattttagtaaacgttgggatcggggtaaggacggtcggtgagtaaggtaaagcgttttttattttagtttttttttttacgtttttttaaagcggtgaatgtgatttttttaattttatattttgttttcgttgtaggtagtgatattggagttggttcgagttttttaagttcggttagaaagtttttgcgttaacgttaaggttagagatgggttttaggagcgttgttgtattttggtcgtcggtttttcgcgggggtaaggttgtgtttttagttaatgattaaataagtttgtttatatggtgggtgggagagtagagagtttttttttttttgtagagtaaagttttttaattgtttttgtatagggagattagttagttcggaaaattgaaatgtgttgtttaaaagagatttgaagtgtatggggttttgaataagggtaggttttggtttttgtgggttttggaaagatagggtttttagaggaaaacgtatatttttatttcgttttttagtatttgggaagatcggaaatagggtaaaggttggtatattgaggggagggcgaatgaaatgggggggggtcggttaatgaaagtttagggataaggagagagtaagaaagaaaaagaaaagggagaagggaaagtaggggaagagcggaagagaaagagaaaatggaagaagaaataaaaacgagaagaaagaggacgtgtataggaaagagaaggaaagaattaagagaagtgattcggcgcgtagatttgggttataagtatcggattcggagttttttttttagtagtttggtttttggttagtttcggttttatttgttaggcgtaaggcggatatgcgttggaattcgggtttttgaagttatttttatattttgcggaaggtttttttgttagatttgagtttattttacggttttggatttcggagtaggtcggagagagttttttgagatcggtatagtattttttgcgtaaagatcgtttgggggatattgtagcgttttagtttcgttgtgatgcgttgggttatttttttggtgttgattttttttagttggttcgacgtggttatttgcgagttcgatgaggacgagggtggtcgttcgcgattgggtgttagtatcggttcgtgagattgagtgtggttcgggtggtgtaggtcgtttaggtgcgatattatggtcgtaggtggggtgtttaggtcgcgggataggtgttgtttatcgcgggttagtatggtagtgtggtgcgcgtcgaagttggggttgagtattttgtcgtggttcggcggatcgtagttgggtagattttgttgcgcgttgtggaggtcgtttagttcgttgtttagcggcgtggcggttagcggggataggttttggtttatgtcgggtatttttttgtagggattgtagaggttgtttatggtcgggagttcgcgttcgtcgcgtatgagggtgaagttgtcgttgacgttgtcggataggcgttggtggtggtggtggtggtggtggtgcggatggtggtgcgggtgagggtggtggaatttgttagatacggtggagatgggtggtagcggttggagcggtgttagcgtggtgtaggtgttgtttatgtttatgttaggcggagacgagtcgtaggatatgtttatggcgtggtgtagcgggatggagagttcgggtcggtagtcgtcgtcgtttaggatcgaggttatgttggtgattatggtcgagcgcgacgtcgtcgttgtcgtcgttgtcgtcgtgtttagtttttggtgcgcggttggaggcggcggagggtttcgtagcgagttagcggcgtcgcggttcgcgtggtgggggttggggttggttagtagtttttgtttatggttcgggttttcgtcgtcgttttcgtcgttttcgtcgtcgttttcgttattgtcgtcgtcggtcggttcgtgtaaagtgtttagattttttattgttagtttcgggtttatggcgtagttttttaggtttttggtgaggtatcgataggcggtgtaggtagtttttatttagtttattagggttcgggggcggcgggggcggcgggggcggtcggcgggcgggtaaggcgcgcgtggcggggttcggttgcgggagtgggggcgggcgcgggagtgagtggagaggagtgcgcgtgcgggtgtgcgtttcgggttgcgggcgggttcgttcggggtgggggcggggtgggggcggacggggcgtgcgtgcgggagaggggaggggacggggagggagggagggattatcgggtttcgtcgttcgggtcggttcgtagtttcgttatgttcgagttcgtttcggcgtcgacgttttttgtttgggtgagcgggagttgtttagaagggttttgtcgttcgtcggggtagttaatttattttttcggatttggggcggggttacgttcgacgggcgttaagcgtaattatttcgaggtcgtagttgtttcgggaggcgggttttttacgggaagttattagtggttgtggagggggcggggtcgtattttttaggtttggttgacggttcggtgttttttttattttttttgttattggaattaaacgttaaggagagggagggaggagaaggtgggggggtcgttggggagagggaggttggagtgcgagcgagcgagagagattcggtgaaagatgtcgtgttgtgttttttttgagtagttgcgatttgggggaaggggtattgttttaatcgttttcgttttattttaaagtttttttggaggcgagtaagtcgggagtaaaagatttcgttatgtgttagtatagataaatattcgttattaataagttatttatcgagagtttttagttgggagttaatagtttagttttttaaaatgtaggcgttaatgtattttaatgtatggtaaattttcgaggtcgggatatgtataatttacgcggttagagtaattgtagtgttttcgtcgttagcgagttgcggtcggtcggcggtttacgggcggcg

SEQ ID NO: 381 - DNA, 2494 bp, Artificial Sequence
  chemically treated genomic DNA (Homo sapiens)
tttttatgaagttataaagttgtaatttcgtttttatgtgtagtattataggttttgtttttaaatatttgtaggtgtatttttttgtattcgttaaattaagggttttttttttttgtgttagattcgtttttacgattacgttttttatttgatttatagaaagggttttacgatcgttaggttatcgtcgtttttgtattttattggggagtcgaaggttttagcgttgttcgcgatttttttaaggtggtcgggaaggttttaattacgtttttttgtaaattagataaggaaggtttggggatttcggtcgcggaaaggtatagaggaggtgaacgtttcggatgtttaagtgacgtatttgtaggcggattcggaaattcgtgtttttgagtcggaggcggagtttttagatttagatcgattttttagaatcgggcggttttgttcgaggtatgaaggttttttaggttcgtttttaaaagttgtgtataatggagatttttggaataggtatatatttttattgtaattagaacgagatgtaatatttaagacgtagggtagggttttggtaaagatacgttgggggaacgtgaaagaaagggttaaaattacgtagttggtttttagagattaaagattacgatttttagtatttaatgtagtgaatttttaggacgttgtatgtcgggagttgtagttttttattatcgttattttttcgttttttcgttatttgaaagggttttaggggatttgtaatttttttcgtgtgtttttttttttcgagaagcgtcgttatacgagaaagttggtcgcgaaagtcgtgttggaattatttttaacgaaattttaggtatagatgggaaagggtgaagaatacgttgttatggttatcgttttttcggttacggaataaacgttttttaggattcggaagtagtttcgtcgcgatttttttaaaaggatggatgtgttttttgtttatatttattggacgtttttttttagaggttaaggtcgtttaggtaaaggggcggttttacgtgtgaggggttcgcggagttatttgattggagaaaagttgtaaattttgattaatcggaaggagttacgtttcgggtatcggttatcgtatttggatagtttcgattggtggattttcgttttttttacgaatttttattgggtgtcgtgggtgcgtggtgcggcgcgattggtgggtttatgtttttcgtttttcgttcgcgagaagtgggggtgaaaagcggttcgatttgtttggggtgtagtgggcggatcgcgcggttggaggtgtgaggattcgaatttaggggtggaggcggtttttgcgatcgaaggggatttgagatttatcggtcgtacgttatgagggttttgtgggtgttgggtttttgttgcgttttgttgattttcggtgagtgattttggaggagtagacgttttttttttatatacgcggtcgtttttcgaaggttttgggggcgttgaacgtgggaggggggatttcggggtttgcggtgggttaagggacgttattatttttcgaaagagggtaagggaattacgtttatttttttttttttttggaaataaaaaaagagagtaatattatttaattgttttatagatttaatagtatttcgttcggaggttttagcgatttcggggtggggtttttttgaggttttggttttttcgggagttgtgcgagtttttttttttttttcgttcggaggattttttcggttatcgtaattttcggttattttagttttttcgttttttaattttttagatttcgatttttcgtaagttcgtgtttttttttagatgttggtttcgggagcgtgaggtttggggttagcggaatggtagtgttagcgtgtttgatttagttttgttggagttcggtttttaatatttttttttttttttatgtttttgggtttaattttagtttttttcgttagaggttgtataaattttatttgtattttgatttgtgttaacgaaggtcgaagttttggtttgattagttgggaggttttggttcggtttgcgcgtaatacgtgtgggtgtagaagaggtttggtattagtttgtttaacgttatttataaatgatcggagatatattgtttagaagtggtgattgttttcgtattttaggatttattggagattttagtatttgaatttaaatagatgttttgttttggttttatttttggtatttaaattagggaatgtatttttttatttttattttttttagttattaattgaattttgtaatttttatttttttttatttgattattttttttggagaagtgtgatgttgaagagtttgttcgtgttaaatttttagggtcggttagagttgacgatgaagttgatgtggatggtatagtagaagaggatttgggtaaaagtagagaaggattaaggacggatgatgaagt

SEQ ID NO: 382 - DNA, 2494 bp, Artificial Sequence
  chemically treated genomic DNA (Homo sapiens)
attttattattcgtttttgatttttttttatttttatttagatttttttttattgtattatttatattaattttatcgttagttttgatcgattttgaagatttaatacgggtaaattttttaatattatatttttttaaggaggatgattaaatagggaagggtaggggttgtaaaatttagttggtaattaagggaggtggggatgaaagagtgtattttttggtttaaatattaaaggtaaagttaagatagaatatttatttaagtttagatgttgaggtttttagtagattttgaaatacggaggtagttattatttttaaatagtgtgttttcgattatttataaataacgttaagtagattgatattaggttttttttatatttatacgtgttgcgcgtaggtcgagttaaggttttttaattgattaagttaaaatttcggttttcgttagtataggttagaatgtaaataggatttatgtaatttttggcgaggggaattgaaattgagtttagaggtatgagaagggggagaaatgttaagaatcgaattttagtaaaattgaattaaatacgttgatattgttatttcgttggttttaggttttacgttttcgaggttagtatttaagaagggatacgggtttgcgaggagtcggagtttggggaattaggggacgggaaagttgggatggtcgaaggttgcggtggtcgaaaaagtttttcgggcggggaggggggaggggttcgtatagttttcgggggagttagagttttagagaggttttatttcgaggtcgttgagattttcgggcgagatattattagatttgtagggtagttagatgatgttgttttttttttttatttttagaggaagaagagaataaacgtaatttttttgttttttttcgaggaatggtgacgttttttggtttatcgtaggtttcgggatttttttttttacgtttaacgtttttaggattttcgagaagcggtcgcgtgtgtggaggggggacgtttgtttttttagaattatttatcgaaggttagtaggacgtagtagaggtttagtatttatagggtttttatggcgtgcggtcggtgagttttaagtttttttcgatcgtaggagtcgtttttatttttgggttcggatttttatatttttagtcgcgcggttcgtttattatattttaagtaggtcgggtcgttttttatttttatttttcgcgggcgggggacgggaaatatgaatttattaatcgcgtcgtattacgtatttacggtatttaatgaggattcgtgaggggggcggaagtttattaatcggagttgtttaggtgcggtgatcgatgttcgaagcgtggtttttttcgattggttagggtttgtagtttttttttaattaaatggtttcgcgggttttttatacgtgggatcgtttttttgtttgggcggttttggtttttaagggaaaacgtttaatgaatgtaagtagagaatatatttatttttttagagaggtcgcggcggaattattttcggattttagagagcgtttatttcgtgatcggggaaacggtagttatggtaacgtgttttttatttttttttatttatgtttggggtttcgttggaagtgattttagtacgattttcgcggttagttttttcgtgtggcggcgtttttcggaaagaagaaatatacgagagaggttgtaaattttttagaatttttttagatggcgggggggcgggggggtggcggtggtgagaaattatagttttcggtatgtaacgttttaggggtttattgtattgaatgttgggggtcgtagtttttggtttttgaggattagttgcgtagttttggtttttttttttacgtttttttagcgtgtttttgttagagttttgttttgcgttttagatgttatatttcgttttgattatagtagagatatgtgtttattttaggagtttttattgtatatagtttttagaagcgggtttagaaagtttttatgtttcgggtaaggtcgttcggttttggggggtcggtttgagtttgggggtttcgttttcggtttaagagtacgagttttcgaattcgtttataagtgcgttatttgggtattcggagcgtttattttttttgtgttttttcgcggtcggaatttttaggttttttttatttggtttatagaagaacgtggttgggattttttcgattattttagggaaatcgcgagtagcgttgaggttttcgattttttaataaagtataaaggcggcggtgatttgacggtcgtagaattttttttgtgaattaggtggagagcgtggtcgtaaaagcgggtttagtatagaaaaggaaaatttttagtttaacgagtgtaggaggatgtatttgtagatatttgaaagtaaaatttgtggtgttgtatatgagaacgggattgtagttttgtaattttatagaaa

SEQ ID NO: 383 - DNA, 2476 bp, Artificial Sequence
  chemically treated genomic DNA (Homo sapiens)
aattattaggaggttgggggaaaagaggggaaaaacgggtaaggaaggttgtaaatgttaagatgttaaataggaatttaatcgaagttcgaagtgaaatatagttttttttggtttaattgttatgtaaataatttttaagtatttttagatgtaaagaaaaatagttattgtgtataggcgttagttgaatgttcgagagttggatgaatggggaagatttgttatatatttagtggtgggtggattttattaggttgtagtttttatatagtttttttttgttgtattgtagaggcgttatttttttcgttttaatttttatttaattcgatttttttatttgtattttaaaaaaaagatttttcggattttttttagtattttgtgtttttaggggaattaaattagagtttttagagttgttagggaagaggtcgcgttttaattagataaacgtttttttggatgtataggatagagttcgtgtttttttattattcgttattgttttttttagacgtatattttatttttcgttttatttttttttcgttaaggattttatagtttagtatagaattaagtttcggaggtgattcgagggtgggaagtagaggggtttcgaggtttcgttagaagtttcggtagcgtttttgtttttttttaggcggacgcgtagtttcgggaagggagtcgggcgggagtttcggtggcgtattgagattaacgcggttcggtttacggcgagggcggggtgtcgcggtttttgttttcgcggattttttgttttttagatagagtttagggtgcgagcgaattttcgggacgtttagatttggggaaggcgcggggtggttatgggttttcgattttttttatttttcgtaagttatataaaagggagacgcggatatgtataaagtttgtttgtggaaggcggtgcgcgatttcgacgtcggttcgggttagggtcgtatttaggttgtcgtcgttagtagtcgcgaaaagaggttggagtaaggaagggggatgggggtgagagaggaaggtgaaacgaggcggagaacgtagggaaaagcgaggggtttttagttttttgggttgtttcgattttttttttttttttttagggtttaagagaaaggaaagggtaacgatttaagagcgaaggattggttttagggacgttgcgttttcggttttttttacgtgttttttttttttttttttttgtttgaatgtttttcgtttttttcgattttcgtttttaaggtagggattaagtcggggtttgggtttagggtcgttttttatttttttcgtttcgggttggcgcggaattagggagattagcgtttcgttcgtttttttttagcgggtcggagcgcgattttttggggtagggttgggtcgaaagcggggatgcgttggacgttcgtaagcgggggcggagaggagaggggttttattgacggattttcggtttttttgtattaaagatttgggttaaggttttggggggtatcgcgtttttatcgtgtagttttttttcgtttttcgaggcgcggtatttatttttagcgttcgagtcgtttaggcggttagtaggagtagtgttaaatcgggtagtatcgcgattttgcgcggggtatcgagtgcgttgttgtgcgagtgggattcgtcgcgtttttgttttgttcgcgtcgttatcgtcgtcgtttttcggggttttcgcgtacgttttttcgcgtgttttcgtttatcgttgtcgaggaaattgacggagttcgagcgcggcggcggggtttagagttaggcgagttagttgattcggtttatttcgttcggtattcgagagagatttttagcggcgtcgtcggggaattgcgttcgttcgcgtcgggaggggttttcgcgtttcgcgtttataggtgtacgcgtttttggcgtcgtttgtattttacgcgtttttttcgtttttcggtcgacggtttatttgggtttcgtgaatagtgggagggagagtttggggttaggagagggacggtgtaggattagggaaaggtgagttttaggacgttgaggttttagaaaagtcgagagcgtttttgttcgttttcgtgagtttgaattattcgatttcgtaggtttttcgggggtgtcgtataaaggattgttgttagggtgcgtttttattcgtatttcgttttttttttcggtttggagaggtggggtaggcgtttttggaagagaatgagaacgagtgaagtttaaaggaaataggattttttttgtttgttgagatagtaaaattttattttttaatttttaacgttaaaagtaggtacgagtaatttggaatttttatttttagaacgaattaaaggagtaaggcgtaggatttggtaaagaagcggttaatttatttatttttttttgaaagtagggttttgggtttgggttttgttttttt

SEQ ID NO: 384 - DNA, 2476 bp, Artificial Sequence
  chemically treated genomic DNA (Homo sapiens)
aaagaaataaaatttaagtttagaattttgtttttaagaagaagtaaatgggttggtcgtttttttgttaggttttgcgttttgtttttttggttcgttttaaagatagaaattttaggttgttcgtgtttgtttttgacgttgggggttaaaaaatgaggttttgttgttttaataagtaaagaaaattttattttttttaagttttattcgtttttatttttttttagaaacgtttgttttatttttttaaatcgagagaaaaaacgaaatgcggataaaaacgtattttagtagtagttttttatacgatattttcgggaggtttgcggggtcggatgatttaagtttacggggacgagtaggagcgttttcgatttttttagagttttagcgttttaggatttatttttttttgattttgtatcgttttttttttggttttagatttttttttttattgtttacgaagtttaggtgggtcgtcggtcggggagcggagggggcgcgtggggtgtaggcggcgttaagggcgcgtgtatttgtgggcgcggggcgcgagggtttttttcggcgcgagcgggcgtagtttttcggcggcgtcgttaggggtttttttcgggtgtcgagcggggtgggtcggattagttgattcgtttggttttgagtttcgtcgtcgcgttcgggtttcgttagttttttcggtagcggtaggcgagagtacgcggaggagcgtgcgcgggggtttcgggagacggcggcggtggcggcgcgggtagagtaaggacgcggcggattttattcgtatagtagcgtattcggtgtttcgcgtagggtcgcgatgttgttcggtttggtattgtttttgttggtcgtttggacggttcgggcgttggaggtgggtgtcgcgtttcggaaggcggggggaggttgtacggtggggacgcgatattttttaagattttaatttaagtttttaatgtagagaagtcgggggttcgttaatgggatttttttttttttcgttttcgtttgcggacgtttagcgtattttcgttttcggtttagttttgttttagggagtcgcgtttcggttcgttgagagggagcgggcgaggcgttggtttttttggtttcgcgttagttcggggcgagaagggtagggggcgattttgagtttagatttcgatttagtttttgttttggaagcgggggtcgggggaggcgagagatatttagataggggggaagggggaaggagtacgtggggaaaatcgaaaacgtagcgtttttaaagttagtttttcgtttttgaatcgttgttttttttttttttttgggttttggggaggaggaggaggagtcgggatagtttaggaagttaggagtttttcgtttttttttgcgtttttcgtttcgttttattttttttttttatttttattttttttttttgttttaattttttttcgcggttgttggcggcggtagtttgggtgcgattttagttcgagtcggcgtcggggtcgcgtatcgttttttataggtaaattttgtgtatgttcgcgttttttttttgtgtaatttgcgagaaatgggaggggtcggagatttatagttatttcgcgttttttttaagtttggacgtttcgggagttcgttcgtattttaagttttgtttgagaggtagaaggttcgcgggaataaaagtcgcgatatttcgttttcgtcgtgggtcgagtcgcgttagttttagtgcgttatcgaggttttcgttcggtttttttttcggggttgcgcgttcgtttgggagggggtagagacgttgtcggggtttttggcggagtttcggggtttttttgttttttattttcggattattttcgaggtttaattttgtgttgggttgtaaagtttttggcggggaggaaataaggcggagagtgggatgtgcgtttggaaagggtagtggcggatggtggggaggtacgggttttgttttgtgtatttaaggaggcgtttgtttgattaaggcgcggttttttttttggtagttttggggattttggtttagtttttttgggggtataggatgttggggagggttcgaagggttttttttttagggtgtagataaaaggatcgaattgagtgaagattaagacggagaagatggcgtttttgtagtgtagtaaagaaaagttgtgtggaggttgtagtttagtgaaatttatttattattaggtgtataataagttttttttatttatttaattttcgaatatttagttaacgtttgtgtataatgattgtttttttttatatttgaagatgtttagaagttgtttgtatgatagttgggttagaggaggttgtattttatttcggatttcggttgggtttttgtttggtattttaatatttgtaattttttttattcgttttttttttttttttttttagttttttagtaatt

SEQ ID NO: 385 - DNA, 6887 bp, Artificial Sequence
  chemically treated genomic DNA (Homo sapiens)
tgttgtttgtgggttgttggttggttgtagtttgttggtgatgagggtattatagttgttttgattgtgtagattatgtatgttttggttttgggaatttattatgtattagaatatattagtgtttgtattttaaaaggttaaattattggtttttagttagggatttttggtaagtggtttgttagtgatgagtgtttgtttatattggtatatagtggagttttttgtttttggtttatttgtttttaggaaagttttggggtgaggtgaaggtgattgaagtaatgtttttttttttagattgtagttgtttaggggggatatagtatggtattttttattgaattttttttgtttgtttgtattttagtttttttttttttagtgatttttttatttttttttttttttttttttttgatgtttgattttagtagtaaaggaggtaaaaaaggtattgagttgttagttaaatttgaaaagtgtggttttgttttttttatagttattggtagttttttgtggaaggtttgttttttggggtagttgtggttttggagtggttgtgtttggtgtttgttgggtgtggttttgttttaggtttgggagggtaggttggttgttttggtgagtggtagagtttttttggatagtttttgtttatttaaatagaagatgttggtgttggagtgggtttggatatggtgaggttgtgagttggtttgagtggtggggtttggtgatttttttttttttttttgttttttttttttttttgtatgtatgttttgtttgtttttattttgtttttattttgggtgagtttgtttgtagtttggggtgtatatttgtatgtgtatttttttttatttatttttgtgtttgtttttatttttgtagttgagttttgttatgtgtgttttgtttgtttgttggttgtttttgttgtttttgttgtttttgggttttgatggattgaatgaaggttgtttatattgtttattgatgttttattaaagatttagaaggttgtgttatgaatttggagttgataatggaaagtttgggtattttgtatgggttggttggtggtggtagtggtgggggtggtggtgggggtggtgggggtggtggtgggggtttgggttatgagtaggagttgttggttagttttagtttttattatgtgggttgtggtgttgttggtttgttgtggggttttttgttgtttttaattgtgtattaggagttgggtatggtggtagtggtggtagtggtggtgttgtgtttggttatggttattagtatggttttgattttggatggtggtgattattggtttgagttttttattttgttgtattatgttatgagtatgttttgtgatttgtttttgtttggtatgggtatgagtaatatttatattatgttgatattgttttagttgttgttatttatttttattgtgtttgataagttttattatttttatttgtattattatttgtattattattattattattattattagtgtttgtttggtaatgttagtggtagttttatttttatgtgtgatgagtgtgggtttttggttatgaataatttttatagtttttataaggagatgtttggtatgagttagagtttgtttttgttggttgttatgttgttgggtaatgggttaggtggtttttataatgtgtagtagagtttgtttaattatggtttgttgggttatgataaaatgtttagttttaattttgatgtgtattatattgttatgttgatttgtggtgagtaatatttgttttgtggtttgggtattttatttgtggttatgatgttgtatttgaatggtttgtattatttgggttatatttagttttatgggttggtgttggtatttagttgtgagtggttatttttgtttttattgggtttgtaggtggttatgttgggttagttggaagaaattaatattaaagaggtggtttagtgtattatagtggagttgaagtgttatagtattttttaggtgatttttgtgtagagggtgttgtgttggttttaggggattttttttgatttgttttggaatttaaaattgtggagtaaatttaaatttggtagggagattttttgtaggatgtggaagtggttttaggagtttgagttttagtgtatgtttgttttatgtttggtaggtaaggttggggttagttaggggttaggttgttgggaagagggttttgggtttggtgtttgtggtttaagtttgtgtgttgagttattttttttgatttttttttttttttttttatatatgttttttttttttttgtttttatttttttttttatttttttttttttttttgttttttttttatttttttttttttttttttttttttttttttattttttttttgtttttgagtttttattgattgatttttttttattttatttgttttttttttaatgtgttaatttttgttttatttttgatttttttaggtattgggaggtgggatgggggtgtgtgtttttttttaggagttttgtttttttaagatttatagaaattaggatttgtttttatttaaaattttatgtattttaagttttttttagataatatattttaattttttgggttgattagtttttttgtgtagaggtagttgagaggttttgttttgtagagggaaaagagttttttatttttttatttattatataggtaaatttatttggttattggttgaaggtatagttttgtttttgtggggaattggtggttaggatataatagtgtttttggagtttatttttggttttggtgttggtgtagggattttttgattgggtttgaggggtttgggttagttttaatgttattatttatagtgagggtagggtgtaaggttgagaaggttatatttattgttttgggaggatgtgggagaagagattgaggtggaaagtgttttgttttgtttattggttgtttttgttttggttttagtgtttgttgggatttgttaggatttgttggggttttgggagattttgagtatttgtaggaagaggtgttgagaaattaaaaatttaggttagttaatgtatttttgttgttggttgtaggttttgtttttgtattaagtgggtgttgattgtgtgtgtttggtgattgtggggaggattggtggtttgtgggaggggatgggtagaggtgtgggttatattgttttggagttggtttggttttttgtgttttttttagtggttaagttgtgaggtatagttttttattgttttaggagtatagaaattttttgtgtgggtggtgggtgtgtgagttagagggaaagatgtagtagttattgtgattggtatgtagttgtgtgtttttgtgtgtatggattttgtgtggtgtgtgtggtgattgtgttgtttttaggagtaagttatgggtttagaggggtaaaatgtttaggttttttgttgggaaggatatattatattttatggtaagttagggtgggtgattttttatggattgggtggaggggggtattttttaggattggtgggtggtttaggggaataatttgtggtggtgatgatttgtatagtgtgggttttgggatgtgtgtggttttgagttagttttgtatagtttgtttttggagttgtgagtttaggtttttatttttgattttttgggttttttttgtattgttgagtttagtttgtggggtgtatttgattaatgtttgatagggttggggaatgtgataggtagtaggtttatttgggtttggggagggggagtttttgttttgatagtatttttttttgttgtttgttggtggatttttatttttagttggtaattgttttgtagtgttgatttaagaaggtaaagaaaattaggtttttttgtaaagagttttttttaaattggtggattttggatattttgagtggatttagaaatttatgtaattttttttttttagtttattttttatttttttttatagttttttttgatttgttgttggtttggggtaagataaagtagttagtagagagtgataataatagtggtgggaaatgaattggagattggttgatagtttttaatattttgttatagatttttttgaatgttttaggttgtttttggtgggttttagtatttgttggttttttgggtattggggattagaaggaatttggtagttggttttaggggtatagttaaaggtaggatgatagttatttttttgtttattttagagtgttgttgtttttttatgttggttgtgtaaagaatatagtttttaaaaaatatgtgttttttgtttatataggtttgaaagtgatgaggaaagtaatgttttgtttattagtgagttttagtttttaaaatgattttaagtgttgttgagatgagaaagtgtggtattttgggggtttttagttttatttgtgtttatggtgtaagtttgtagggataggtttgggatagtattgtttatgttgttagattttttgtagaggattgttgaagttgtttttgtgggagatagaatgttttttttagtgagtggaaaaggtttgttgaggattttgttttgtttgagtatttaaatgtgtgtttgttttattattttgggttgaaaagggataagagttttagtttttttatttggttattttattagtaattataagtgtgttgagtggttattattatataggaggttttttagtttggggttagtagattagtttttttagatattgatgtagaagttgggattggtaagtaggtattatgtgtttggagtgttaggggataggagtaaatggagaagaaaagtggaggttttttttgtttggagtattgattggaatttttgttggtatgttgtagagggtttttgttgttgggttttgggggtttaataagtttagttgttttgtaggtggtttggttggatttttagattggtgtttggaagatattgtttttgttttttttttgttaaatttgtttttttttttttttttataggttataggtttttttttttttttattttggttttgtttttgggttttgttaaatagttaagtaggttggggtttagggggtttagaatgaagaggtttgatttggttagtgttggtaaagtttatttttaggtgaggttataatagaggtaggttttttttgtttagtttgttggtgtagttatagttaagggtggtatttgaaaggaaaagggagaaaattttggagaaatttagattgttttaatgttagattttagagaaattgattttaaatgtatggatttgtttggaaagggtggttaagtggtaggtggttgtaattttgtttggttgggtttttgtagaggttttttaagattagtttttgtagggtggtttttagtaatttgataagaggtggttaagataaatttttgtgggtttgagtatatatttttgggtgttgggttttagagatttttaaattaagtataaataagaagggagtgagagaatttaggttagaatttgtatgggtattttattgaggaaaagtgaggttttggtggtaggtatgtttttttttgatgtttgaaaattgagttgagtgtttgattatatttattgtagaggtttttgtttttagtgagtttggattttttagtggtttgtttggagttggtttttagtttttgttgtagtttgatgtatggtttttttttggtagtaagtttttagtggttagtttgaagttaattttgtttaggtggttgagggtttttagttaatttattatgatgttgtttgggttatttgatgtttgtagtggtgggatatggtttgggtagtgtgtagtggtttttgttaggggtattgtgtgtgtgtttgttttttgttgtgttggggatgtttttgggtgatatgggttgttgggtattttttaagttgaggaaatggattttttttgtagagttttgtgtttattttttaattttttattttgttttttgttgttagggtttttgatttagtttattttttttggtggtttagttagggattagagttggagaggttgaatgtaatttgtgttagtatggaatagatgatatgtttgtttgttagttgtttggatgaataattgaaaagtttgttgtagtttgtgttttgttaagttttgggtgttgggagaatatttttttaatatgtattagggtgggtgggagtgggtagaggaggtgggatttgagggaggagagtgaatttgagtaggagaagtagtttaggtagttaggtgtttttgatgtgagaggttgggtatttatttttattttaggttttttattgtgtggttatgttatttttttaaataaatgtgtatatggagggagattgatgttgataatgtttagaagattaaaagagtattaatgttggtaataataatgtaaatgtgtggatttagattttattgatttggaatttgatttggtgtgtttttagtaagtttgatggtgtgttttttttagtagagtgtttattagtgttatggttttgtggttttttagtggtgttgttttgttagttttgtgtgggtttttttgtttgattgtagttttttttttgtgaggttttagtttgttttatttttttgaggtttttttttttttttgtggggttttttgttttttgtatttttttttttgatttttgtattatttgtttttgtgtgtatatattgttatttgtgtttttggtgatttgtttgggtggttgggtttgtgaagttaatgtgttgaatggtgtttg

SEQ ID NO: 386 - DNA, 6887 bp, Artificial Sequence
  chemically treated genomic DNA (Homo sapiens)
tgggtattgtttagtgtattggttttgtggatttagttgtttaggtggattgttggaagtgtaagtagtggtgtgtgtgtataggggtgggtggtgtagaggttgggggagggggtgtagagggtagagagttttgtgagaggaggagaaaattttggggaagtaaggtgggttggggttttgtgggggaggagttgtggttagatgggagaatttgtgtagagttggtgaagtggtattgttggaaaattgtggggttgtggtgttggtgagtgttttgttgggaagagtgtgttgttgggtttattggaaatgtgttggattaagttttagattaatgaaatttgggtttatatgtttatgttattgttgttagtattaatgtttttttaattttttaaatattattagtattgatttttttttatatatatatttgtttgagaaagtgatataattatatagtggaaagtttggaataaaaataaatgtttagttttttgtattgagggtgtttggttgtttgggttgttttttttgtttgggtttattttttttttttgggttttgttttttttgtttgtttttgtttattttgatgtgtgttgggaaggtgtttttttggtatttgggatttgatgaagtatagattgtagtgaattttttaattatttatttaagtagttagtaggtaaatatattgtttgttttgtattggtatgggttgtgtttagtttttttagttttgatttttaattaaattgttaggagaggtgggttgagttgggagttttagtagtgagaaatgaggtgggaggttggggggtgggtgtgagattttgtgaagggggtttgtttttttggtttgggaggtgtttagtggtttgtgttatttaaggatgtttttggtgtagtgggagataagtatgtatgtggtgtttttagtaggagttattgtgtattgtttgggttgtgttttgttgttgtgggtattaggtggtttaggtgatattatggtgggttggttaagggtttttggttgtttgaatagaattggttttagattggttgttgggagtttgttgttaggagagggttgtgtgttggattatggtggggattggagattagttttgggtaggttgttgggggatttgggtttattggaggtggaaatttttgtagtaaatgtagttgggtgtttggtttgatttttgggtgttggaagaaaatatgtttgttattgaggttttgtttttttttagtgggatgtttgtgtaagttttagtttgggtttttttattttttttttgtttgtgtttggtttagaggtttttggggtttaatgtttgagagtgtgtgtttgaatttgtagaaatttgttttggttgttttttgttaggttgttgaaaattgttttgtaagggttggttttggggaatttttgtgaaggtttgattgggtggggttgtaattatttgttatttagttgttttttttgaatgaatttgtgtatttggagttaatttttttgaaatttaatgttggggtaatttaaatttttttgaagtttttttttttttttttttaagtgttatttttggttgtgattatattggtaggttgggtaggaaggatttgtttttgttgtgattttgtttaagggtgagttttgttggtgttggttaaattagatttttttattttgagttttttaaattttggtttgtttggttgtttggtaggatttgggggtggggttaaaatgagagagaaagggaatttataatttatgagagaaagagaagaggtaggtttggtgggaggggggtagggatggtgttttttaggtattggtttgagagtttggttgagttgtttgtggagtggttgggtttgttaaatttttggggtttaatggtgagggttttttgtggtgtattggtggggattttgattgatattttgggtggagaaagtttttgttttttttttttatttgtttttgttttttagtgttttgagtatataatatttatttattagttttagtttttgtattagtgtttgaagagattgatttattgattttaaattgaaaagttttttatgtaataataattatttaatatatttgtagttgttgataaaatggttagataaaaaggttaaagtttttgtttttttttaatttagggtaataaaatagatatatatttgaatgtttgagtaaagtggggtttttagtaggttttttttatttgttggaggaggtattttgttttttatgaaggtagttttagtgattttttgtggaaaatttagtagtgtgggtagtgttgttttgggtttgtttttgtagatttgtattatgggtgtgggtggggttgaggatttttgggatgttatgtttttttattttagtaatgtttgggattattttaaaagttgaaatttgttaataggtgaagtattattttttttattatttttagatttatatgggtagaaggtatgtgttttttaaaagttgtgttttttgtgtgattggtatgagggggtggtagtgttttgagatgagtaggagaatagttgttattttgtttttaattgtatttttaagattagttgttaagttttttttggtttttggtgtttaagaagttggtgggtattaaaatttattagagatagtttgggatatttggggggatttatgataaaatgttaagaattgttagttagtttttagtttattttttgttgttattattattgttttttattggttgttttattttgttttgaattaatagtaaattagagaaaattgtaggagaggatgaaaaataaattaaaggagaaagattatataaatttttaaatttatttaaagtatttggagtttgttgatttgggggaggttttttgtagggaaatttagttttttttatttttttagattaatattgtggggtgattattgattgggaataggaatttattagtagatggtaaaggaaaatgttgttaaagtggaaattttttttttttaagtttgggtgaatttgttgtttgttatattttttagttttgttgggtgttggttgagtgtattttataagttgggtttagtggtgtgaggaaagtttgggggattgggggtggaaatttgagtttgtagttttggaagtgagttgtgtgaggttggtttggaattgtgtgtattttaagatttgtgttatgtaaattattgttattatgaattgtttttttagattgtttgttgattttgaaagatatttttttttatttgatttatgggaagttgtttattttggtttgttatagggtatagtgtgttttttttagtgggggatttggatattttgtttttttgggtttgtggtttgtttttaggggtagtgtagttgttatgtatattgtgtggggtttgtgtgtataaaagtgtgtaattgtgtgttagttgtagtaattattgtatttttttttttagtttgtgtatttgttgtttatataggaggtttttgtgtttttagaataatagagggttgtattttgtagtttggttgttagaggaggtataaagagttgagttggttttagaataatgtaatttgtgtttttatttgtttttttttgtgggttgttagttttttttgtggttgttaggtgtgtataattagtgtttgtttaatgtaaaggtggagtttgtagttggtggtagggatgtattaattaatttgaatttttaattttttagtatttttttttgtgagtgtttagggttttttggagttttggtaaattttggtaaattttagtaaatgttgggattggggtaaggatggttggtgagtaaggtaaagtgttttttattttagtttttttttttatgtttttttaaagtggtgaatgtgatttttttaattttatattttgtttttgttgtaggtagtgatattggagttggtttgagttttttaagtttggttagaaagtttttgtgttaatgttaaggttagagatgggttttaggagtgttgttgtattttggttgttggttttttgtgggggtaaggttgtgtttttagttaatgattaaataagtttgtttatatggtgggtgggagagtagagagtttttttttttttgtagagtaaagttttttaattgtttttgtatagggagattagttagtttggaaaattgaaatgtgttgtttaaaagagatttgaagtgtatggggttttgaataagggtaggttttggtttttgtgggttttggaaagatagggtttttagaggaaaatgtatatttttattttgttttttagtatttgggaagattggaaatagggtaaaggttggtatattgaggggagggtgaatgaaatgggggggggttggttaatgaaagtttagggataaggagagagtaagaaagaaaaagaaaagggagaagggaaagtaggggaagagtggaagagaaagagaaaatggaagaagaaataaaaatgagaagaaagaggatgtgtataggaaagagaaggaaagaattaagagaagtgatttggtgtgtagatttgggttataagtattggatttggagttttttttttagtagtttggtttttggttagttttggttttatttgttaggtgtaaggtggatatgtgttggaatttgggtttttgaagttatttttatattttgtggaaggtttttttgttagatttgagtttattttatggttttggattttggagtaggttggagagagttttttgagattggtatagtattttttgtgtaaagattgtttgggggatattgtagtgttttagttttgttgtgatgtgttgggttatttttttggtgttgattttttttagttggtttgatgtggttatttgtgagtttgatgaggatgagggtggttgtttgtgattgggtgttagtattggtttgtgagattgagtgtggtttgggtggtgtaggttgtttaggtgtgatattatggttgtaggtggggtgtttaggttgtgggataggtgttgtttattgtgggttagtatggtagtgtggtgtgtgttgaagttggggttgagtattttgttgtggtttggtggattgtagttgggtagattttgttgtgtgttgtggaggttgtttagtttgttgtttagtggtgtggtggttagtggggataggttttggtttatgttgggtatttttttgtagggattgtagaggttgtttatggttgggagtttgtgtttgttgtgtatgagggtgaagttgttgttgatgttgttggataggtgttggtggtggtggtggtggtggtggtgtggatggtggtgtgggtgagggtggtggaatttgttagatatggtggagatgggtggtagtggttggagtggtgttagtgtggtgtaggtgttgtttatgtttatgttaggtggagatgagttgtaggatatgtttatggtgtggtgtagtgggatggagagtttgggttggtagttgttgttgtttaggattgaggttatgttggtgattatggttgagtgtgatgttgttgttgttgttgttgttgttgtgtttagtttttggtgtgtggttggaggtggtggagggttttgtagtgagttagtggtgttgtggtttgtgtggtgggggttggggttggttagtagtttttgtttatggtttgggtttttgttgttgtttttgttgtttttgttgttgtttttgttattgttgttgttggttggtttgtgtaaagtgtttagattttttattgttagttttgggtttatggtgtagttttttaggtttttggtgaggtattgataggtggtgtaggtagtttttatttagtttattagggtttgggggtggtgggggtggtgggggtggttggtgggtgggtaaggtgtgtgtggtggggtttggttgtgggagtgggggtgggtgtgggagtgagtggagaggagtgtgtgtgtgggtgtgtgttttgggttgtgggtgggtttgtttggggtgggggtggggtgggggtggatggggtgtgtgtgtgggagaggggaggggatggggagggagggagggattattgggttttgttgtttgggttggtttgtagttttgttatgtttgagtttgttttggtgttgatgttttttgtttgggtgagtgggagttgtttagaagggttttgttgtttgttggggtagttaatttatttttttggatttggggtggggttatgtttgatgggtgttaagtgtaattattttgaggttgtagttgttttgggaggtgggttttttatgggaagttattagtggttgtggagggggtggggttgtattttttaggtttggttgatggtttggtgttttttttattttttttgttattggaattaaatgttaaggagagggagggaggagaaggtgggggggttgttggggagagggaggttggagtgtgagtgagtgagagagatttggtgaaagatgttgtgttgtgttttttttgagtagttgtgatttgggggaaggggtattgttttaattgtttttgttttattttaaagtttttttggaggtgagtaagttgggagtaaaagattttgttatgtgttagtatagataaatatttgttattaataagttatttattgagagtttttagttgggagttaatagtttagttttttaaaatgtaggtgttaatgtattttaatgtatggtaaatttttgaggttgggatatgtataatttatgtggttagagtaattgtagtgtttttgttgttagtgagttgtggttggttggtggtttatgggtggtg

SEQ ID NO: 387 - DNA, 2494 bp, Artificial Sequence
  chemically treated genomic DNA (Homo sapiens)
tttttatgaagttataaagttgtaattttgtttttatgtgtagtattataggttttgtttttaaatatttgtaggtgtatttttttgtatttgttaaattaagggttttttttttttgtgttagatttgtttttatgattatgttttttatttgatttatagaaagggttttatgattgttaggttattgttgtttttgtattttattggggagttgaaggttttagtgttgtttgtgatttttttaaggtggttgggaaggttttaattatgtttttttgtaaattagataaggaaggtttggggattttggttgtggaaaggtatagaggaggtgaatgttttggatgtttaagtgatgtatttgtaggtggatttggaaatttgtgtttttgagttggaggtggagtttttagatttagattgattttttagaattgggtggttttgtttgaggtatgaaggttttttaggtttgtttttaaaagttgtgtataatggagatttttggaataggtatatatttttattgtaattagaatgagatgtaatatttaagatgtagggtagggttttggtaaagatatgttgggggaatgtgaaagaaagggttaaaattatgtagttggtttttagagattaaagattatgatttttagtatttaatgtagtgaatttttaggatgttgtatgttgggagttgtagttttttattattgttatttttttgtttttttgttatttgaaagggttttaggggatttgtaattttttttgtgtgttttttttttttgagaagtgttgttatatgagaaagttggttgtgaaagttgtgttggaattatttttaatgaaattttaggtatagatgggaaagggtgaagaatatgttgttatggttattgtttttttggttatggaataaatgttttttaggatttggaagtagttttgttgtgatttttttaaaaggatggatgtgttttttgtttatatttattggatgtttttttttagaggttaaggttgtttaggtaaaggggtggttttatgtgtgaggggtttgtggagttatttgattggagaaaagttgtaaattttgattaattggaaggagttatgttttgggtattggttattgtatttggatagttttgattggtggatttttgttttttttatgaatttttattgggtgttgtgggtgtgtggtgtggtgtgattggtgggtttatgttttttgttttttgtttgtgagaagtgggggtgaaaagtggtttgatttgtttggggtgtagtgggtggattgtgtggttggaggtgtgaggatttgaatttaggggtggaggtggtttttgtgattgaaggggatttgagatttattggttgtatgttatgagggttttgtgggtgttgggtttttgttgtgttttgttgatttttggtgagtgattttggaggagtagatgttttttttttatatatgtggttgttttttgaaggttttgggggtgttgaatgtgggaggggggattttggggtttgtggtgggttaagggatgttattattttttgaaagagggtaagggaattatgtttatttttttttttttttggaaataaaaaaagagagtaatattatttaattgttttatagatttaatagtattttgtttggaggttttagtgattttggggtggggtttttttgaggttttggtttttttgggagttgtgtgagttttttttttttttttgtttggaggatttttttggttattgtaatttttggttattttagtttttttgttttttaattttttagattttgattttttgtaagtttgtgtttttttttagatgttggttttgggagtgtgaggtttggggttagtggaatggtagtgttagtgtgtttgatttagttttgttggagtttggtttttaatatttttttttttttttatgtttttgggtttaattttagttttttttgttagaggttgtataaattttatttgtattttgatttgtgttaatgaaggttgaagttttggtttgattagttgggaggttttggtttggtttgtgtgtaatatgtgtgggtgtagaagaggtttggtattagtttgtttaatgttatttataaatgattggagatatattgtttagaagtggtgattgtttttgtattttaggatttattggagattttagtatttgaatttaaatagatgttttgttttggttttatttttggtatttaaattagggaatgtatttttttatttttattttttttagttattaattgaattttgtaatttttatttttttttatttgattattttttttggagaagtgtgatgttgaagagtttgtttgtgttaaatttttagggttggttagagttgatgatgaagttgatgtggatggtatagtagaagaggatttgggtaaaagtagagaaggattaaggatggatgatgaagt

SEQ ID NO: 388 - DNA, 2494 bp, Artificial Sequence
  chemically treated genomic DNA (Homo sapiens)
attttattatttgtttttgatttttttttatttttatttagatttttttttattgtattatttatattaattttattgttagttttgattgattttgaagatttaatatgggtaaattttttaatattatatttttttaaggaggatgattaaatagggaagggtaggggttgtaaaatttagttggtaattaagggaggtggggatgaaagagtgtattttttggtttaaatattaaaggtaaagttaagatagaatatttatttaagtttagatgttgaggtttttagtagattttgaaatatggaggtagttattatttttaaatagtgtgtttttgattatttataaataatgttaagtagattgatattaggttttttttatatttatatgtgttgtgtgtaggttgagttaaggttttttaattgattaagttaaaattttggtttttgttagtataggttagaatgtaaataggatttatgtaatttttggtgaggggaattgaaattgagtttagaggtatgagaagggggagaaatgttaagaattgaattttagtaaaattgaattaaatatgttgatattgttattttgttggttttaggttttatgtttttgaggttagtatttaagaagggatatgggtttgtgaggagttggagtttggggaattaggggatgggaaagttgggatggttgaaggttgtggtggttgaaaaagttttttgggtggggaggggggaggggtttgtatagtttttgggggagttagagttttagagaggttttattttgaggttgttgagatttttgggtgagatattattagatttgtagggtagttagatgatgttgttttttttttttatttttagaggaagaagagaataaatgtaatttttttgtttttttttgaggaatggtgatgttttttggtttattgtaggttttgggatttttttttttatgtttaatgtttttaggatttttgagaagtggttgtgtgtgtggaggggggatgtttgtttttttagaattatttattgaaggttagtaggatgtagtagaggtttagtatttatagggtttttatggtgtgtggttggtgagttttaagttttttttgattgtaggagttgtttttatttttgggtttggatttttatatttttagttgtgtggtttgtttattatattttaagtaggttgggttgttttttatttttattttttgtgggtgggggatgggaaatatgaatttattaattgtgttgtattatgtatttatggtatttaatgaggatttgtgaggggggtggaagtttattaattggagttgtttaggtgtggtgattgatgtttgaagtgtggttttttttgattggttagggtttgtagtttttttttaattaaatggttttgtgggttttttatatgtgggattgtttttttgtttgggtggttttggtttttaagggaaaatgtttaatgaatgtaagtagagaatatatttatttttttagagaggttgtggtggaattatttttggattttagagagtgtttattttgtgattggggaaatggtagttatggtaatgtgttttttatttttttttatttatgtttggggttttgttggaagtgattttagtatgatttttgtggttagtttttttgtgtggtggtgttttttggaaagaagaaatatatgagagaggttgtaaattttttagaatttttttagatggtgggggggtgggggggtggtggtggtgagaaattatagtttttggtatgtaatgttttaggggtttattgtattgaatgttgggggttgtagtttttggtttttgaggattagttgtgtagttttggtttttttttttatgtttttttagtgtgtttttgttagagttttgttttgtgttttagatgttatattttgttttgattatagtagagatatgtgtttattttaggagtttttattgtatatagtttttagaagtgggtttagaaagtttttatgttttgggtaaggttgtttggttttggggggttggtttgagtttgggggttttgtttttggtttaagagtatgagtttttgaatttgtttataagtgtgttatttgggtatttggagtgtttattttttttgtgtttttttgtggttggaatttttaggttttttttatttggtttatagaagaatgtggttgggatttttttgattattttagggaaattgtgagtagtgttgaggtttttgattttttaataaagtataaaggtggtggtgatttgatggttgtagaattttttttgtgaattaggtggagagtgtggttgtaaaagtgggtttagtatagaaaaggaaaatttttagtttaatgagtgtaggaggatgtatttgtagatatttgaaagtaaaatttgtggtgttgtatatgagaatgggattgtagttttgtaattttatagaaa

SEQ ID NO: 389 - DNA, 2476 bp, Artificial Sequence
  chemically treated genomic DNA (Homo sapiens)
aattattaggaggttgggggaaaagaggggaaaaatgggtaaggaaggttgtaaatgttaagatgttaaataggaatttaattgaagtttgaagtgaaatatagttttttttggtttaattgttatgtaaataatttttaagtatttttagatgtaaagaaaaatagttattgtgtataggtgttagttgaatgtttgagagttggatgaatggggaagatttgttatatatttagtggtgggtggattttattaggttgtagtttttatatagtttttttttgttgtattgtagaggtgttattttttttgttttaatttttatttaatttgatttttttatttgtattttaaaaaaaagattttttggattttttttagtattttgtgtttttaggggaattaaattagagtttttagagttgttagggaagaggttgtgttttaattagataaatgtttttttggatgtataggatagagtttgtgtttttttattatttgttattgttttttttagatgtatattttattttttgttttattttttttttgttaaggattttatagtttagtatagaattaagttttggaggtgatttgagggtgggaagtagaggggttttgaggttttgttagaagttttggtagtgtttttgtttttttttaggtggatgtgtagttttgggaagggagttgggtgggagttttggtggtgtattgagattaatgtggtttggtttatggtgagggtggggtgttgtggtttttgtttttgtggattttttgttttttagatagagtttagggtgtgagtgaatttttgggatgtttagatttggggaaggtgtggggtggttatgggtttttgattttttttattttttgtaagttatataaaagggagatgtggatatgtataaagtttgtttgtggaaggtggtgtgtgattttgatgttggtttgggttagggttgtatttaggttgttgttgttagtagttgtgaaaagaggttggagtaaggaagggggatgggggtgagagaggaaggtgaaatgaggtggagaatgtagggaaaagtgaggggtttttagttttttgggttgttttgattttttttttttttttttagggtttaagagaaaggaaagggtaatgatttaagagtgaaggattggttttagggatgttgtgtttttggttttttttatgtgttttttttttttttttttttgtttgaatgttttttgttttttttgatttttgtttttaaggtagggattaagttggggtttgggtttagggttgttttttattttttttgttttgggttggtgtggaattagggagattagtgttttgtttgtttttttttagtgggttggagtgtgattttttggggtagggttgggttgaaagtggggatgtgttggatgtttgtaagtgggggtggagaggagaggggttttattgatggatttttggtttttttgtattaaagatttgggttaaggttttggggggtattgtgtttttattgtgtagtttttttttgttttttgaggtgtggtatttatttttagtgtttgagttgtttaggtggttagtaggagtagtgttaaattgggtagtattgtgattttgtgtggggtattgagtgtgttgttgtgtgagtgggatttgttgtgtttttgttttgtttgtgttgttattgttgttgttttttggggtttttgtgtatgtttttttgtgtgtttttgtttattgttgttgaggaaattgatggagtttgagtgtggtggtggggtttagagttaggtgagttagttgatttggtttattttgtttggtatttgagagagatttttagtggtgttgttggggaattgtgtttgtttgtgttgggaggggtttttgtgttttgtgtttataggtgtatgtgtttttggtgttgtttgtattttatgtgttttttttgttttttggttgatggtttatttgggttttgtgaatagtgggagggagagtttggggttaggagagggatggtgtaggattagggaaaggtgagttttaggatgttgaggttttagaaaagttgagagtgtttttgtttgtttttgtgagtttgaattatttgattttgtaggttttttgggggtgttgtataaaggattgttgttagggtgtgtttttatttgtattttgtttttttttttggtttggagaggtggggtaggtgtttttggaagagaatgagaatgagtgaagtttaaaggaaataggattttttttgtttgttgagatagtaaaattttattttttaatttttaatgttaaaagtaggtatgagtaatttggaatttttatttttagaatgaattaaaggagtaaggtgtaggatttggtaaagaagtggttaatttatttatttttttttgaaagtagggttttgggtttgggttttgttttttt

SEQ ID NO: 390 - DNA, 2476 bp, Artificial Sequence
  chemically treated genomic DNA (Homo sapiens)
aaagaaataaaatttaagtttagaattttgtttttaagaagaagtaaatgggttggttgtttttttgttaggttttgtgttttgtttttttggtttgttttaaagatagaaattttaggttgtttgtgtttgtttttgatgttgggggttaaaaaatgaggttttgttgttttaataagtaaagaaaattttattttttttaagttttatttgtttttatttttttttagaaatgtttgttttatttttttaaattgagagaaaaaatgaaatgtggataaaaatgtattttagtagtagttttttatatgatatttttgggaggtttgtggggttggatgatttaagtttatggggatgagtaggagtgtttttgatttttttagagttttagtgttttaggatttatttttttttgattttgtattgttttttttttggttttagatttttttttttattgtttatgaagtttaggtgggttgttggttggggagtggagggggtgtgtggggtgtaggtggtgttaagggtgtgtgtatttgtgggtgtggggtgtgagggttttttttggtgtgagtgggtgtagttttttggtggtgttgttaggggttttttttgggtgttgagtggggtgggttggattagttgatttgtttggttttgagttttgttgttgtgtttgggttttgttagtttttttggtagtggtaggtgagagtatgtggaggagtgtgtgtgggggttttgggagatggtggtggtggtggtgtgggtagagtaaggatgtggtggattttatttgtatagtagtgtatttggtgttttgtgtagggttgtgatgttgtttggtttggtattgtttttgttggttgtttggatggtttgggtgttggaggtgggtgttgtgttttggaaggtggggggaggttgtatggtggggatgtgatattttttaagattttaatttaagtttttaatgtagagaagttgggggtttgttaatgggattttttttttttttgtttttgtttgtggatgtttagtgtatttttgtttttggtttagttttgttttagggagttgtgttttggtttgttgagagggagtgggtgaggtgttggtttttttggttttgtgttagtttggggtgagaagggtagggggtgattttgagtttagattttgatttagtttttgttttggaagtgggggttgggggaggtgagagatatttagataggggggaagggggaaggagtatgtggggaaaattgaaaatgtagtgtttttaaagttagttttttgtttttgaattgttgttttttttttttttttgggttttggggaggaggaggaggagttgggatagtttaggaagttaggagttttttgtttttttttgtgttttttgttttgttttattttttttttttatttttattttttttttttgttttaatttttttttgtggttgttggtggtggtagtttgggtgtgattttagtttgagttggtgttggggttgtgtattgttttttataggtaaattttgtgtatgtttgtgttttttttttgtgtaatttgtgagaaatgggaggggttggagatttatagttattttgtgttttttttaagtttggatgttttgggagtttgtttgtattttaagttttgtttgagaggtagaaggtttgtgggaataaaagttgtgatattttgtttttgttgtgggttgagttgtgttagttttagtgtgttattgaggtttttgtttggttttttttttggggttgtgtgtttgtttgggagggggtagagatgttgttggggtttttggtggagttttggggtttttttgttttttatttttggattatttttgaggtttaattttgtgttgggttgtaaagtttttggtggggaggaaataaggtggagagtgggatgtgtgtttggaaagggtagtggtggatggtggggaggtatgggttttgttttgtgtatttaaggaggtgtttgtttgattaaggtgtggttttttttttggtagttttggggattttggtttagtttttttgggggtataggatgttggggagggtttgaagggttttttttttagggtgtagataaaaggattgaattgagtgaagattaagatggagaagatggtgtttttgtagtgtagtaaagaaaagttgtgtggaggttgtagtttagtgaaatttatttattattaggtgtataataagttttttttatttatttaatttttgaatatttagttaatgtttgtgtataatgattgtttttttttatatttgaagatgtttagaagttgtttgtatgatagttgggttagaggaggttgtattttattttggattttggttgggtttttgtttggtattttaatatttgtaattttttttatttgttttttttttttttttttttagttttttagtaatt

We claim:

1. A method for detecting and/or classifying a colorectal carcinoma or pre-cancerous colorectal cell proliferative disorder in a human subject, comprising:
   contacting genomic DNA from a biological sample obtained from a human subject, having a colorectal carcinoma or pre-cancerous colorectal cell proliferative disorder, with at least one agent that provides for determination of a CpG methylation status of the FOXL2 gene;
   determining, based on said contacting, a CpG methylation status of the FOXL2 gene; and
   detecting and/or classifying a colorectal carcinoma or pre-cancerous colorectal cell proliferative disorder in the subject based on increased CpG methylation of the FOXL2 gene, relative to that of a control sample or standard value.

2. The method of claim 1, wherein said cell proliferative disorder is colorectal cancer.

3. The method of claim 1, wherein said colorectal carcinoma is detected or classified.

4. The method of claim 1, wherein contacting genomic DNA comprises contacting the genomic DNA with at least one reagent, or series of reagents that distinguishes between methylated and non-methylated CpG dinucleotides within at least one target region of the genomic DNA, wherein the target region comprises, or hybridizes under stringent conditions to a sequence of at least 16 contiguous nucleotides of SEQ ID NO:24, wherein said contiguous nucleotides comprise at least one CpG dinucleotide sequence.

5. The method of claim 4, comprising:
   extracting or otherwise isolating genomic DNA from the biological sample obtained from the a subject;

treating the extracted or otherwise isolated genomic DNA, or a fragment thereof, with one or more reagents to convert cytosine bases that are unmethylated in the 5-position thereof to uracil or to another base that is detectably dissimilar to cytosine in terms of hybridization properties;

contacting the treated genomic DNA, or the treated fragment thereof, with an amplification enzyme and at least one primer comprising, a contiguous sequence of at least 9 nucleotides that is complementary to, or hybridizes under moderately stringent or stringent conditions to a sequence selected from the group consisting of SEQ ID NOS:30,31,42 and SEQ ID NO:43, and complements thereof, wherein the treated genomic DNA or the fragment thereof is either amplified to produce at least one amplificate, or is not amplified; and determining, based on a presence or absence of, or on a property of said amplificate, the methylation state or level of at least one CpG dinucleotide of SEQ ID NO:24, or an average, or a value reflecting an average methylation state or level of a plurality of CpG dinucleotides of SEQ ID NO:24.

6. The method of claim 4, wherein treating the genomic DNA, or the fragment thereof, consisting use of a reagent selected from the group comprising of bisulfite, hydrogen sulfite, disulfite, and combinations thereof.

7. The method according to claim 4, comprising:
extracting or otherwise isolating genomic DNA from the biological sample obtained from the subject;
digesting the extracted or otherwise isolated genomic DNA, or a fragment thereof, with one or more methylation sensitive restriction enzymes;
contacting the DNA restriction enzyme digest with an amplification enzyme and at least two primers suitable for the amplification of a sequence comprising at least one CpG dinucleotide of SEQ ID NO:24; and
determining, based on a presence or absence of an amplificate, the methylation state or level of at least one CpG dinucleotide of SEQ ID NO:24.

8. The method according to claim 7, wherein the presence or absence of an amplificate is determined by means of hybridization to at least one nucleic acid or peptide nucleic acid which is identical, complementary, or hybridizes under stringent or highly stringent conditions to an at least 16 base long segment of SEQ ID NO:24.

* * * * *

UNITED STATES PATENT AND TRADEMARK OFFICE
CERTIFICATE OF CORRECTION

PATENT NO. : 7,951,563 B2
APPLICATION NO. : 11/911617
DATED : May 31, 2011
INVENTOR(S) : Distler et al.

It is certified that error appears in the above-identified patent and that said Letters Patent is hereby corrected as shown below:

Please amend the below-identified section of Line 4 in Column 11 as follows:
--SEQ ID NOS:[[10]]4 to SEQ ID NO:15--

Please amend the below-identified section of Line 25 in Column 11 as follows:
--SEQ ID NOS:[[10]]4 to SEQ ID NO:15--

Please amend the below-identified section of Line 45 in Column 11 as follows:
--SEQ ID NOS:[[10]]4 to SEQ ID NO:15--

Please amend the below-identified section of Lines 54 and 55 in Column 11 as follows:
--SEQ ID NOS:[[10]]4 to SEQ ID NO:15--

Please amend the below-identified section of Lines 63 and 64 in Column 11 as follows:
--SEQ ID NOS:[[10]]4 to SEQ ID NO:15--

Please amend the below-identified section of Lines 23 and 24 in Column 21 as follows:
--SEQ ID NOS:[[10]]4 to SEQ ID NO:15--

Please amend the below-identified section of Lines 31 and 32 in Column 22 as follows:
--SEQ ID NOS:[[10]]4 to SEQ ID NO:15--

Please amend the below-identified section of Lines 62 and 63 in Column 22 as follows:
--SEQ ID NOS:[[10]]4 to SEQ ID NO:15--

Please amend the below-identified section of Line 37 in Column 30 as follows:
--SEQ ID NOS:[[10]]4 to SEQ ID NO:15--

Please amend the below-identified section of Line 44 in Column 30 as follows:
--SEQ ID NOS:[[10]]4 to SEQ ID NO:15--

Signed and Sealed this
Thirtieth Day of August, 2011

David J. Kappos
*Director of the United States Patent and Trademark Office*

CERTIFICATE OF CORRECTION (continued)
U.S. Pat. No. 7,951,563 B2

Please amend the below-identified section of Line 51 in Column 30 as follows:
--SEQ ID NOS:[[10]]4 to SEQ ID NO:15--

Please amend the below-identified section of Lines 60 and 61 in Column 30 as follows:
--SEQ ID NOS:[[10]]4 to SEQ ID NO:15--

Please amend the below-identified section of Line 39 in Column 31 as follows:
--SEQ ID NOS:[[10]]4 to SEQ ID NO:15--

Please amend the below-identified section of Lines 62 and 63 in Column 31 as follows:
--SEQ ID NOS:[[10]]4 to SEQ ID NO:15--

Please amend the below-identified section of Lines 10 and 11 in Column 32 as follows:
--SEQ ID NOS:[[10]]4 to SEQ ID NO:15--

Please amend the below-identified section of Line 18 in Column 32 as follows:
--SEQ ID NOS:[[10]]4 to SEQ ID NO:15--

Please amend the below-identified section of Line 36 in Column 32 as follows:
--SEQ ID NOS:[[10]]4 to SEQ ID NO:15--

Please amend the below-identified section of Lines 38 and 39 in Column 33 as follows:
--SEQ ID NOS:[[10]]4 to SEQ ID NO:15--

Please amend the below-identified section of Lines 56 and 57 in Column 33 as follows:
--SEQ ID NOS:[[10]]4 to SEQ ID NO:15--

Please amend the below-identified section of Lines 36 and 37 in Column 34 as follows:
--SEQ ID NOS:[[10]]4 to SEQ ID NO:15--

Please amend the below-identified section of Lines 49 and 50 in Column 34 as follows:
--SEQ ID NOS:[[10]]4 to SEQ ID NO:15--

Please amend the below-identified section of Line 61 in Column 34 as follows:
--SEQ ID NOS:[[10]]4 to SEQ ID NO:15--

Please amend the below-identified section of Lines 8 and 9 in Column 35 as follows:
--SEQ ID NOS:[[10]]4 to SEQ ID NO:15--

Please amend the below-identified section of Line 46 in Column 37 as follows:
--SEQ ID NOS:[[10]]4 to SEQ ID NO:15--

Please amend the below-identified section of Lines 3 and 4 in Column 38 as follows:
--SEQ ID NOS:[[10]]4 to SEQ ID NO:15--

CERTIFICATE OF CORRECTION (continued)
U.S. Pat. No. 7,951,563 B2

Please amend the below-identified section of Lines 62 and 63 in Column 38 as follows:
--SEQ ID NOS:[[10]]4 to SEQ ID NO:15--

Please amend the below-identified section of Lines 27 and 28 in Column 40 as follows:
--SEQ ID NOS:[[10]]4 to SEQ ID NO:15--

Please amend the below-identified section of Line 36 in Column 41 as follows:
--SEQ ID NOS:[[10]]4 to SEQ ID NO:15--

Please amend the below-identified section of Line 47 in Column 44 as follows:
--SEQ ID NOS:[[10]]4 to SEQ ID NO:15--

Please amend the below-identified section of Line 66 in Column 44 as follows:
--SEQ ID NOS:[[10]]4 to SEQ ID NO:15--

Please amend the below-identified section of Lines 41 and 42 in Column 45 as follows:
--SEQ ID NOS:[[10]]4 to SEQ ID NO:15--

Please amend the below-identified section of Lines 53 and 54 in Column 45 as follows:
--SEQ ID NOS:[[10]]4 to SEQ ID NO:15--

Please amend the below-identified section of Line 67 in Column 45 and
Line 1 in Column 46 as follows:
--SEQ ID NOS:[[10]]4 to SEQ ID NO:15--

Please amend the below-identified section of Line 8 in Column 46 as follows:
--SEQ ID NOS:[[10]]4 to SEQ ID NO:15--

Please amend the below-identified section of Lines 51 and 52 in Column 48 as follows:
--SEQ ID NOS:[[10]]4 to SEQ ID NO:15--

Please amend the below-identified section of Lines 64 and 65 in Column 48 as follows:
--SEQ ID NOS:[[10]]4 to SEQ ID NO:15--

Please amend the below-identified section of Line 11 in Column 49 as follows:
--SEQ ID NOS:[[10]]4 to SEQ ID NO:15--

UNITED STATES PATENT AND TRADEMARK OFFICE
CERTIFICATE OF CORRECTION

| | | |
|---|---|---|
| PATENT NO. | : 7,951,563 B2 | Page 1 of 1 |
| APPLICATION NO. | : 11/911617 | |
| DATED | : May 31, 2011 | |
| INVENTOR(S) | : Juergen Distler et al. | |

It is certified that error appears in the above-identified patent and that said Letters Patent is hereby corrected as shown below:

In The Claims

In column 93, lines 23-24 and column 94, lines 1-2, please amend claim 6 as follows:

6. The method of claim 4, wherein treating the genomic DNA, or the fragment thereof, comprises use of a reagent selected from the group consisting of bisulfite, hydrogen sulfite, disulfite, and combinations thereof.

Signed and Sealed this
Twenty-eighth Day of April, 2015

Michelle K. Lee
*Director of the United States Patent and Trademark Office*